(12) United States Patent
Raum et al.

(10) Patent No.: US 12,258,404 B2
(45) Date of Patent: Mar. 25, 2025

(54) BISPECIFIC ANTIBODY CONSTRUCT DIRECTED TO MUC17 AND CD3

(71) Applicants: AMGEN INC., Thousand Oaks, CA (US); AMGEN RESEARCH (MUNICH) GMBH, Munich (DE)

(72) Inventors: Tobias Raum, Munich (DE); Tara Arvedson, Thousand Oaks, CA (US); Julie Bailis, Thousand Oaks, CA (US); Christoph Dahlhoff, Munich (DE); Sandra Ross, Thousand Oaks, CA (US); Irwin Chen, Thousand Oaks, CA (US); Claudia Blümel, Munich (DE); Elisabeth Nahrwold, Munich (DE); Jochen Pendzialek, Munich (DE); Joachim Wahl, Munich (DE)

(73) Assignees: AMGEN INC., Thousand Oaks, CA (US); AMGEN RESEARCH (MUNICH) GMBH, Munich (DE)

( * ) Notice: Subject to any disclaimer, the term of this patent is extended or adjusted under 35 U.S.C. 154(b) by 621 days.

(21) Appl. No.: 16/956,797

(22) PCT Filed: Dec. 31, 2018

(86) PCT No.: PCT/US2018/068118
§ 371 (c)(1),
(2) Date: Jun. 22, 2020

(87) PCT Pub. No.: WO2019/133961
PCT Pub. Date: Jul. 4, 2019

(65) Prior Publication Data
US 2021/0130465 A1 May 6, 2021

Related U.S. Application Data

(60) Provisional application No. 62/687,063, filed on Jun. 19, 2018, provisional application No. 62/612,242, filed on Dec. 29, 2017.

(51) Int. Cl.
| | | |
|---|---|---|
| *C07K 16/00* | (2006.01) | |
| *A61K 9/00* | (2006.01) | |
| *A61P 35/00* | (2006.01) | |
| *C07K 16/28* | (2006.01) | |
| *C07K 16/30* | (2006.01) | |
| *A61K 39/00* | (2006.01) | |

(52) U.S. Cl.
CPC ........ *C07K 16/2809* (2013.01); *A61K 9/0019* (2013.01); *A61P 35/00* (2018.01); *C07K 16/3092* (2013.01); *A61K 2039/505* (2013.01); *A61K 2039/54* (2013.01); *A61K 2039/545* (2013.01); *A61K 2039/572* (2013.01); *C07K 2317/31* (2013.01); *C07K 2317/33* (2013.01); *C07K 2317/524* (2013.01); *C07K 2317/526* (2013.01); *C07K 2317/53* (2013.01); *C07K 2317/565* (2013.01); *C07K 2317/622* (2013.01); *C07K 2317/73* (2013.01)

(58) Field of Classification Search
CPC .. C07K 16/2809; C07K 2317/73; A61P 35/00
See application file for complete search history.

(56) References Cited

U.S. PATENT DOCUMENTS

| | | | |
|---|---|---|---|
| 3,691,016 | A | 9/1972 | Patel |
| 3,773,919 | A | 11/1973 | Boswell et al. |
| 3,969,287 | A | 7/1976 | Jaworek et al. |
| 4,179,337 | A | 12/1979 | Davis et al. |
| 4,195,128 | A | 3/1980 | Gribnau et al. |
| 4,229,537 | A | 10/1980 | Hodgins et al. |
| 4,247,642 | A | 1/1981 | Hirohara et al. |
| 4,301,144 | A | 11/1981 | Washita et al. |
| 4,330,440 | A | 5/1982 | Ayers et al. |
| 4,439,196 | A | 3/1984 | Higuchi |
| 4,447,224 | A | 5/1984 | Decant et al. |
| 4,447,233 | A | 5/1984 | Mayfield |
| 4,475,196 | A | 10/1984 | La Zor |
| 4,485,045 | A | 11/1984 | Regen |
| 4,486,194 | A | 12/1984 | Ferrara |
| 4,487,603 | A | 12/1984 | Harris |
| 4,496,689 | A | 1/1985 | Mitra |
| 4,544,545 | A | 10/1985 | Ryan et al. |

(Continued)

FOREIGN PATENT DOCUMENTS

| | | | |
|---|---|---|---|
| EP | 0088046 | A2 | 9/1983 |
| EP | 0133988 | A2 | 3/1985 |

(Continued)

OTHER PUBLICATIONS

Altschul et al., Basic local alignment search tool, J. Mol. Biol., 215:403-410 (1990).

(Continued)

*Primary Examiner* — Mark Halvorson
(74) *Attorney, Agent, or Firm* — MARSHALL, GERSTEIN & BORUN LLP

(57) ABSTRACT

The present invention provides bispecific antibody constructs characterized by comprising a first domain binding to MUC17, a second domain binding to an extracellular epitope of the human and the *Macaca* CD3ε chain and optionally a third domain, which is a specific Fc modality. Moreover, the invention provides a polynucleotide, encoding the antibody construct, a vector comprising this polynucleotide, host cells, expressing the construct and a pharmaceutical composition comprising the same.

19 Claims, 8 Drawing Sheets
Specification includes a Sequence Listing.

(56) References Cited

U.S. PATENT DOCUMENTS

| | | |
|---|---|---|
| 4,596,556 A | 6/1986 | Morrow et al. |
| 4,640,835 A | 2/1987 | Shimizu et al. |
| 4,670,417 A | 6/1987 | Iwasaki et al. |
| 4,694,778 A | 9/1987 | Learn et al. |
| 4,751,180 A | 6/1988 | Cousens et al. |
| 4,790,824 A | 12/1988 | Morrow et al. |
| 4,791,192 A | 12/1988 | Nakagawa et al. |
| 4,816,397 A | 3/1989 | Boss et al. |
| 4,816,567 A | 3/1989 | Cabilly et al. |
| 4,935,233 A | 6/1990 | Bell et al. |
| 4,941,880 A | 7/1990 | Burns |
| 4,946,778 A | 8/1990 | Ladner et al. |
| 5,013,556 A | 5/1991 | Woodle et al. |
| 5,064,413 A | 11/1991 | McKinnon et al. |
| 5,223,409 A | 6/1993 | Ladner et al. |
| 5,225,539 A | 7/1993 | Winter |
| 5,260,203 A | 11/1993 | Ladner et al. |
| 5,292,658 A | 3/1994 | Cormier et al. |
| 5,312,335 A | 5/1994 | McKinnon et al. |
| 5,383,851 A | 1/1995 | McKinnon et al. |
| 5,399,163 A | 3/1995 | Peterson et al. |
| 5,418,155 A | 5/1995 | Cormier et al. |
| 5,476,996 A | 12/1995 | Wilson et al. |
| 5,545,806 A | 8/1996 | Lonberg et al. |
| 5,545,807 A | 8/1996 | Surani et al. |
| 5,565,332 A | 10/1996 | Hoogenboom et al. |
| 5,569,825 A | 10/1996 | Lonberg et al. |
| 5,585,089 A | 12/1996 | Queen et al. |
| 5,591,669 A | 1/1997 | Krimpenfort et al. |
| 5,612,205 A | 3/1997 | Kay et al. |
| 5,625,126 A | 4/1997 | Lonberg et al. |
| 5,625,825 A | 4/1997 | Rostoker et al. |
| 5,633,425 A | 5/1997 | Lonberg et al. |
| 5,643,763 A | 7/1997 | Dunn et al. |
| 5,648,260 A | 7/1997 | Winter et al. |
| 5,661,016 A | 8/1997 | Lonberg et al. |
| 5,683,888 A | 11/1997 | Campbell |
| 5,693,761 A | 12/1997 | Queen et al. |
| 5,693,762 A | 12/1997 | Queen et al. |
| 5,698,767 A | 12/1997 | Wilson et al. |
| 5,721,367 A | 2/1998 | Kay et al. |
| 5,741,668 A | 4/1998 | Ward et al. |
| 5,770,429 A | 6/1998 | Lonberg et al. |
| 5,777,079 A | 7/1998 | Tsien et al. |
| 5,789,215 A | 8/1998 | Berns et al. |
| 5,789,650 A | 8/1998 | Lonberg et al. |
| 5,804,387 A | 9/1998 | Cormack et al. |
| 5,814,318 A | 9/1998 | Lonberg et al. |
| 5,859,205 A | 1/1999 | Adair et al. |
| 5,874,299 A | 2/1999 | Lonberg et al. |
| 5,874,304 A | 2/1999 | Zolotukhin et al. |
| 5,876,995 A | 3/1999 | Bryan |
| 5,877,397 A | 3/1999 | Lonberg et al. |
| 5,925,558 A | 7/1999 | Tsien et al. |
| 5,939,598 A | 8/1999 | Kucherlapati et al. |
| 5,958,765 A | 9/1999 | Brams et al. |
| 5,981,175 A | 11/1999 | Loring et al. |
| 6,023,010 A | 2/2000 | Krimpenfort et al. |
| 6,075,181 A | 6/2000 | Kucherlapati et al. |
| 6,114,598 A | 9/2000 | Kucherlapati et al. |
| 6,150,584 A | 11/2000 | Kucherlapati et al. |
| 6,162,963 A | 12/2000 | Kucherlapati et al. |
| 6,255,458 B1 | 7/2001 | Lonberg et al. |
| 6,300,064 B1 | 10/2001 | Knappik et al. |
| 6,407,213 B1 | 6/2002 | Carter et al. |
| 6,673,986 B1 | 1/2004 | Kucherlapati et al. |
| 7,466,008 B2 | 12/2008 | Ko et al. |
| 7,574,748 B2 | 8/2009 | Fisher et al. |
| 7,575,962 B2 | 8/2009 | Cho et al. |
| 7,610,515 B2 | 10/2009 | Kosuge et al. |
| 7,904,068 B2 | 3/2011 | Hicks, III |
| 7,919,297 B2 | 4/2011 | Lei |
| 8,112,848 B2 | 2/2012 | Takazawa et al. |
| 8,155,301 B2 | 4/2012 | Wang |
| 8,161,739 B2 | 4/2012 | Degler et al. |
| 8,165,699 B2 | 4/2012 | Ueno et al. |
| 8,209,741 B2 | 6/2012 | Elson et al. |
| 8,234,145 B2 | 7/2012 | Kissner et al. |
| 8,376,279 B2 | 2/2013 | Parks et al. |
| 8,430,938 B1 | 4/2013 | Miller |
| 8,462,837 B2 | 6/2013 | Lin et al. |
| 8,463,191 B2 | 6/2013 | Farajidana et al. |
| 8,464,584 B2 | 6/2013 | Lassota et al. |
| 8,486,853 B2 | 7/2013 | Shiratori et al. |
| 8,486,859 B2 | 7/2013 | Seifert et al. |
| 8,759,620 B2 | 6/2014 | Chen et al. |
| 2003/0070185 A1 | 4/2003 | Jakobovits et al. |
| 2005/0076395 A1 | 4/2005 | Kucherlapati et al. |
| 2005/0100925 A1 | 5/2005 | Batra et al. |
| 2014/0302037 A1 | 10/2014 | Borges et al. |
| 2014/0308285 A1 | 10/2014 | Yan et al. |

FOREIGN PATENT DOCUMENTS

| | | |
|---|---|---|
| EP | 0171496 A2 | 2/1986 |
| EP | 0173494 A2 | 3/1986 |
| EP | 0183070 A2 | 6/1986 |
| EP | 0058481 B1 | 10/1986 |
| EP | 0244234 A2 | 11/1987 |
| EP | 0143949 B1 | 10/1988 |
| EP | 0036676 B2 | 9/1990 |
| EP | 0402226 A1 | 12/1990 |
| EP | 0463151 A1 | 1/1992 |
| EP | 0239400 B1 | 8/1994 |
| EP | 0773288 A2 | 5/1997 |
| EP | 0546073 B1 | 9/1997 |
| EP | 0843961 A1 | 5/1998 |
| EP | 2172483 A1 | 4/2010 |
| GB | 2177096 A | 1/1987 |
| JP | 3068180 B2 | 7/2000 |
| JP | 3068506 B2 | 7/2000 |
| JP | 3068507 B2 | 7/2000 |
| WO | 1987/05330 A1 | 9/1987 |
| WO | 1988/01649 A1 | 3/1988 |
| WO | 1988/09344 A1 | 12/1988 |
| WO | 1991/10741 A1 | 7/1991 |
| WO | 1992/03918 A1 | 3/1992 |
| WO | 1992/15673 A1 | 9/1992 |
| WO | 1992/22645 A1 | 12/1992 |
| WO | 1992/22647 A1 | 12/1992 |
| WO | 1992/22670 A1 | 12/1992 |
| WO | 1993/12227 A1 | 6/1993 |
| WO | 1993/15722 A1 | 8/1993 |
| WO | 1994/00569 A1 | 1/1994 |
| WO | 1994/02602 A1 | 2/1994 |
| WO | 1994/25585 A1 | 11/1994 |
| WO | 1995/07463 A1 | 3/1995 |
| WO | 1996/14436 A1 | 5/1996 |
| WO | 1996/33735 A1 | 10/1996 |
| WO | 1996/34096 A1 | 10/1996 |
| WO | 1997/13852 A1 | 4/1997 |
| WO | 1997/38731 A1 | 10/1997 |
| WO | 1998/14605 A1 | 4/1998 |
| WO | 1998/24884 A1 | 6/1998 |
| WO | 1998/24893 A2 | 6/1998 |
| WO | 1998/26277 A2 | 6/1998 |
| WO | 1998/52976 A1 | 11/1998 |
| WO | 1999/49019 A2 | 9/1999 |
| WO | 1999/54440 A1 | 10/1999 |
| WO | 2000/06605 A2 | 2/2000 |
| WO | 2000/34317 A2 | 6/2000 |
| WO | 2000/76310 A1 | 12/2000 |
| WO | 2003/47336 A2 | 6/2003 |
| WO | 2005/040220 A1 | 5/2005 |
| WO | 2006/138181 A2 | 12/2006 |
| WO | 2007/042261 A2 | 4/2007 |
| WO | 2008/119567 A2 | 10/2008 |
| WO | 2010/037836 A2 | 4/2010 |
| WO | 2010/037838 A2 | 4/2010 |
| WO | 2011/121110 A1 | 10/2011 |
| WO | 2013/026833 A1 | 2/2013 |
| WO | 2013/026837 A1 | 2/2013 |
| WO | 2014/144722 A2 | 9/2014 |
| WO | 2014/151910 A1 | 9/2014 |

(56) References Cited

FOREIGN PATENT DOCUMENTS

| WO | 2015/048272 A1 | 4/2015 | | |
|---|---|---|---|---|
| WO | WO 2016/166360 | * | 10/2016 | ........... C07K 16/468 |
| WO | 2017/134140 A1 | 8/2017 | | |

OTHER PUBLICATIONS

Altschul et al., Gapped BLAST and PSI-BLAST: a new generation of protein database search programs, Nucl. Acids Res., 25:3389-3402 (1997).
Altschul et al., Local alignment statistics, Methods Enzymol., 266:460-480 (1996).
Aplin et al., Preparation, properties, and applications of carbohydrate conjugates of proteins and lipids, CRC Crit. Rev. Biochem., 10(4):259-306 (1981).
Arakawa et al., Protein—solvent interactions in pharmaceutical formulations, Pharm Res., 8(3):285-291 (1991).
Artsaenko et al., Expression of a single-chain Fv antibody against abscisic acid creates a willy phenotype in transgenic tobacco, Plant J., 8:745-750 (1995).
Bird et al., Single-chain antigen-binding proteins, Science, 242:423-426 (1988).
Bruhl et al., Depletion of CCR5-expressing cells with bispecific antibodies and chemokine toxins: a new strategy in the treatment of chronic inflammatory diseases and HIV, J. Immunol., 166:2420-2426 (2001).
Carter et al., High level *Escherichia coli* expression and production of a bivalent humanized antibody fragment, Biotechnology, 10:163-167 (1992).
Chalfie et al., Green fluorescent protein as a marker for gene expression, Science, 263:802-805 (1994).
Cheadle et al., Cloning and expression of the variable regions of mouse myeloma protein MOPC315 in *E. coli*: recovery of active FV fragments, Mol. Immunol., 29:21-30 (1992).
Cheson et al., Report of an international workshop to standardize response criteria for non-hodgkin's lymphomas. NCI sponsored international working group, J. Clin. Oncol., 17(4):1244 (1999).
Chothia et al., Canonical structures for the hypervariable regions of immunoglobulins, J. Mol. Biol., 196:901-917 (1987).
Chothia et al., Conformations of immunoglobulin hypervariable regions, Nature, 342:877-883 (1989).
Clackson et al., Making antibody fragments using phage display libraries, Nature, 352:624-628 (1991).
Cole et al., Monoclonal antibodies and cancer therapy, Alan R. Liss, Inc., 77-96 (1985).
Cook et al., The human immunoglobulin VH repertoire, Immunol. Today, 16(5):237-242 (1995).
Cunningham et al., High-resolution epitope mapping of hGH-receptor interactions by alanine-scanning mutagenesis, Science, 244:1081-1085 (1989).
Dall'Acqua et al., Contribution of domain interface residues to the stability of antibody CH3 domain homodimers, Biochem., 37:9266-9273 (1998).
Devereux et al., A comprehensive set of sequence analysis programs for the VAX, Nucl. Acid Res., 12:387-395 (1984).
Duksin et al., Relationship of the structure and biological activity of the natural homologues of tunicamycin, J. Biol. Chem., 257:3105-3109 (1982).
Edge et al., Deglycosylation of glycoproteins by trifluoromethanesulfonic acid, Anal. Biochem., 118:131-137 (1981).
Eppstein et al., Biological activity of liposome-encapsulated murine interferon gamma is mediated by a cell membrane receptor, Proc. Natl. Acad. Sci. USA, 82:3688-3692 (1985).
Fan et al., Bispecific antibodies and their applications, J. Hematol. Oncol., 8:130 (2015).
Fecker et al., Expression of single-chain antibody fragments (scFv) specific for beet necrotic yellow vein virus coat protein or 25 kDa protein in *Escherichia coli* and *Nicotiana benthamiana*, Plant Mol. Biol., 32:979-986 (1996).
Feng et al., Progressive sequence alignment as a prerequisite to correct phylogenetic trees, J. Mol. Evol., 35:351-360 (1987).
Gabizon et al., Pharmacokinetics and tissue distribution of doxorubicin encapsulated in stable liposomes with long circulation times, J. Natl. Cancer Inst., 81(19):1484-1488(1989).
Genbank Accession No. U55762, Cloning vector pEGFP-N1, complete sequence, enhanced green fluorescent protein (egfp) and neomycin phosphotransferase genes, complete cds, Clontech Laboratories, Inc., (2003).
Graham et al., Characteristics of a human cell line transformed by DNA from human adenovirus type 5, J. Gen. Virol., 36:59-74 (1977).
Green et al., Antigen-specific human monoclonal antibodies from mice engineered with human Ig heavy and light chain YACs, Nat. Genet., 7:13-21 (1994).
Green et al., Regulation of B cell development by variable gene complexity in mice reconstituted with human immunoglobulin yeast artificial chromosomes, J. Exp. Med., 188:483-495 (1998).
Gum et al., MUC17, a novel membrane-tethered mucin, Biochem. Biophys. Res. Comm., 291:466-475 (2002).
Hakimuddin et al., A chemical method for the deglycosylation of proteins, Arch. Biochem. Biophys., 159:52-57 (1987).
Hattrup et al., Structure and function of the cell surface (tethered) mucins, Annu. Rev. Physiol., 70:431-457 (2008).
Hawkins et al., Selection of phage antibodies by binding affinity. Mimicking affinity maturation, J. Mol. Biol., 224:889-896 (1992).
Heim et al., Engineering green fluorescent protein for improved brightness, longer wavelengths and fluorescence resonance energy transfer, Curr. Biol., 6:178-182 (1996).
Hiatt et al., Production of antibodies in transgenic plants, Nature, 342:76-78 (1989).
Higgins et al., Fast and sensitive multiple sequence alignments on a microcomputer, Comp. Appl. Biosci., 5:151-153 (1989).
Hollingsworth et al., Mucins in cancer: protection and control of the cell surface, Nat. Rev. Cancer, 4(1):45-60 (2004).
Huston et al., Protein engineering of antibody binding sites: recovery of specific activity in an anti-digoxin single-chain Fv analogue produced in *Escherichia coli*, Proc. Natl. Acad. Sci. USA, 85:5879-5883 (1988).
Hwang et al., Hepatic uptake and degradation of unilamellar sphingomyelin/cholesterol liposomes: a kinetic study, Proc. Natl. Acad. Sci. USA, 77:4030-4034 (1980).
Ichiki et al., Regulation of the expression of human C epsilon germline transcript. Identification of a novel IL-4 responsive element, J. Immunol., 150:5408-5417 (1993).
International Application No. PCT/US2018/068118, International Search Report and Written Opinion, mailed Apr. 12, 2019.
International Application No. PCT/US2018/068118, International Preliminary Report on Patentability, mailed Jul. 9, 2020.
Johansson et al., Immunological aspects of intestinal mucus and mucins, Nat. Rev. Immunol., 16(10):639-649 (2016).
Jones et al., Replacing the complementarity-determining regions in a human antibody with those from a mouse, Nature, 321:522-525 (1986).
Karin et al., Inhibition of insulitis and prevention of diabetes in nonobese diabetic mice by blocking L-selectin and very late antigen 4 adhesion receptors, Proc. Natl. Acad. Sci. U.S.A., 90:5873-5787 (1993).
Kendrick et al., Physical stabilization of proteins in aqueous solution, Pharm. Biotechnol., 13:61-84 (2002).
Kipriyanov et al., Bispecific tandem diabody for tumor therapy with improved antigen binding and pharmacokinetics, J. Mol. Biol., 293:41-56 (1999).
Kohler et al., Continuous cultures of fused cells secreting antibody of predefined specificity, Nature, 256:495-497 (1975).
Kozbor et al., The production of monoclonal antibodies from human lymphocytes, Immunol. Today, 4:72-79 (1983).
Kufer et al., A revival of bispecific antibodies, Trends Biotechnol., 22(5):238-244 (2004).
Kufer et al., Construction and biological activity of a recombinant bispecific single-chain antibody designed for therapy of minimal residual colorectal cancer, Cancer Immunol. Immunother., 45:193-197 (1997).

(56) References Cited

OTHER PUBLICATIONS

Langer et al., Biocompatibility of polymeric delivery systems for macromolecules, J. Biomed. Mater. Res., 15:267-277 (1981).
Langer, Controlled release of macromolecules, Chem. Tech., 12:98-105 (1982).
Leader et al., Protein therapeutics: a summary and pharmacological classification, Nat. Rev. Drug Discov., 7:21-39 (2008).
Loffler et al., A recombinant bispecific single-chain antibody, CD19 x CD3, induces rapid and high lymphoma-directed cytotoxicity by unstimulated T lymphocytes, Blood, 95(6):2098-2103 (2000).
Lowman et al., Selecting high-affinity binding proteins by monovalent phage display, Biochemistry, 30:10832-10838 (1991).
Luu et al., Human intestinal MUC17 mucin augments intestinal cell restitution and enhances healing of experimental colitis, Int. J. Biochem. Cell. Biol., 42(6):996-1006 (2010).
MacCallum et al., Antibody-antigen interactions: contact analysis and binding site topography, J. Mol. Biol., 262:732-745 (1996).
Mack et al., A small bispecific antibody construct expressed as a functional single-chain molecule with high tumor cell cytotoxicity, PNAS, 92:7021-7025 (1995).
Mack et al., Biologic properties of a bispecific single-chain antibody directed against 17-1A (EpCAM) and CD3: tumor cell-dependent T cell stimulation and cytotoxic activity, J. Immunol., 158:3965-3970 (1997).
Macromolecule Sequencing and Synthesis, Selected Methods and Applications, 127-149 (1988), Alan R. Liss, Inc.
Malmborg et al., BIAcore as a tool in antibody engineering, J. Immunol. Methods, 183:7-13 (1995).
Marks et al., By-passing immunization. Human antibodies from V-gene libraries displayed on phage, J. Mol. Biol., 222:581-597 (1991).
Martin et al., Irreversible coupling of immunoglobulin fragments to preformed vesicles. An improved method for liposome targeting, J. Biol. Chem., 257:286-288 (1982).
Martin et al., Structural families in loops of homologous proteins: automatic classification, modelling and application to antibodies, J. Mol. Biol., 263:800-15 (1996).
Mather et al., Culture of testicular cells in hormone-supplemented serum-free medium, Annals N. Y. Acad. Sci., 383:44-68 (1982).
Mather et al., Establishment and characterization of two distinct mouse testicular epithelial cell lines, Biol. Reprod., 23:243-251 (1980).
Mendez et al., Functional transplant of megabase human immunoglobulin loci recapitulates human antibody response in mice, Nature Genetics, 15:146-156 (1997).
Moehle et al., Aberrant intestinal expression and allelic variants of mucin genes associated with inflammatory bowel disease, J. Mol. Med., 84:1055-66 (2006).
Moniaux et al., Characterization of Human Mucin MUC17, J. Biol. Chem., 281(33):23676-23685 (2006).
Morrison et al., Chimeric human antibody molecules: mouse antigen-binding domains with human constant region domains, Proc. Natl. Acad. Sci. USA, 81:6851-6855 (1984).
Morrison et al., Combinatorial alanine-scanning, Cur. Opin. Chem. Biol., 5:302-7 (2001).
Morrison, Transfectomas provide novel chimeric antibodies, Science, 229:1202-1207 (1985).
Needleman et al., A general method applicable to the search for similarities in the amino acid sequence of two proteins, J. Mol. Biol., 48:443-53 (1970).
Nolan et al., Fluorescence-activated cell analysis and sorting of viable mammalian cells based on beta-D-galactosidase activity after transduction of *Escherichia coli* lacZ, Proc. Natl. Acad. Sci. USA., 85:2603-2607 (1988).
Ol et al., Chimeric antibodies, BioTechniques, 4:214-221 (1986).
Olsson et al., Human—human monoclonal antibody-producing hybridomas: technical aspects, Meth. Enzymol., 92:3-16 (1982).
Owen et al., Synthesis of a functional anti-phytochrome single-chain Fv protein in transgenic tobacco, Biotechnology, 10:790-794 (1992).

Padlan, Anatomy of the antibody molecule, Molecular Immunology, 31:169-217 (1993).
Pearson et al., Improved tools for biological sequence comparison, Proc. Nat. Acad. Sci. USA., 85:2444-8 (1988).
Philipp et al., "Diabodies": small bivalent and bispecific antibody fragments, Proc. Natl. Acad. Sci. USA., 90:6444-8 (1993).
Presta, Antibody engineering, Curr. Op. Struct. Biol., 2:593-596 (1992).
Raag et al., Single-chain Fvs, Faseb, J., 9:73-80 (1995).
Randolph et al., Surfactant-protein interactions, Pharm. Biotechnol., 13:159-75 (2002).
Reichmann et al., Reshaping human antibodies for therapy, Nature, 332:323-329 (1988).
Resta-Lenert et al., Muc17 protects intestinal epithelial cells from enteroinvasive *E. coli* infection by promoting epithelial barrier integrity, Am. J. Physiology, 300(6):G1144-G1155 (2011).
Roberts et al., Therapeutic protein aggregation: mechanisms, design, and control, Trends Biotechnol., 32:372-80 (2014).
Schier et al., Efficient in vitro affinity maturation of phage antibodies using BIAcore guided selections, Human Antibodies Hybridomas, 7:97-105 (1996).
Schlereth et al., Cancer Immunol. Immunother., 20:1-12 (2005).
Senapati et al., Expression of intestinal MUC17 membrane-bound mucin in inflammatory and neoplastic diseases of the colon, J. Clin. Pathol., 63(8):1-14 (2010).
Sidman et al., Controlled release of macromolecules and pharmaceuticals from synthetic polypeptides based on glutamic acid, Biopolymers, 22:547-556 (1983).
Skerra et al., Assembly of a functional immunoglobulin Fv fragment in *Escherichia coli*, Science, 242:1038-1041 (1988).
Smith et al., Comparison of biosequences, Adv. Appl. Math., 2:482-89 (1981).
Smith, Filamentous fusion phage: novel expression vectors that display cloned antigens on the virion surface, Science, 228:1315-1317 (1985).
Songsivilai et al., Bispecific antibody: a tool for diagnosis and treatment of disease, Clin. Exp. Immunol., 79:315-321 (1990).
Stauber et al., Development and applications of enhanced green fluorescent protein mutants, Biotechniques, 24:462-471 (1998).
T. E. Creighton, Proteins: Structure and Molecular Properties, W. H. Freeman & Co., San Francisco, 79-86 (1983).
Takeda et al., Construction of chimaeric processed immunoglobulin genes containing mouse variable and human constant region sequences, Nature, 314:452-4 (1985).
Bostrom et al., Improving antibody binding affinity and specificity for therapeutic development. Methods Mol Biol. 525:353-76 (2009).
Gonzales et al., Minimizing the immunogenicity of antibodies for clinical application. Tumour Biol. 26(1):31-43 (2005).
Wark et al., Latest technologies for the enhancement of antibody affinity. Adv Drug Deliv Rev., 58(5-6):657-70 (2006).
Teng et al., Construction and testing of mouse—human heteromyelomas for human monoclonal antibody production, Proc. Natl. Acad. Sci. USA., 80:7308-7312 (1983).
The Pharmacology of Monoclonal Antibodies, Rosenburg and Moore eds. Springer-Verlag, New York, 113:269-315 (1994).
Thotakura et al., Enzymatic deglycosylation of glycoproteins, Meth. Enzymol., 138:350-9 (1987).
Tomlinson et al., The repertoire of human germline VH sequences reveals about fifty groups of VH segments with different hypervariable loops, J. Mol. Biol., 227:776-798 (1992).
Tomlinson et al., The structural repertoire of the human V kappa domain, EMBO. J., 14:4628-4638 (1995).
Urlaub el al., Isolation of Chinese hamster cell mutants deficient in dihydrofolate reductase activity, Proc. Natl. Acad. Sci. USA., 77:4216-20 (1980).
Wang, Instability, stabilization, and formulation of liquid protein pharmaceuticals, Int. J. Pharm., 185:129-88 (1999).
Ward et al., Binding activities of a repertoire of single immunoglobulin variable domains secreted from *Escherichia coli*, Nature, 331:544-546 (1989).

(56) References Cited

OTHER PUBLICATIONS

Yang et al., Bispecific Antibodies as a Development Platform for New Concepts and Treatment Strategies, International Journal of Molecular Sciences, 18:48 (2016).

* cited by examiner

FIG. 7

| OPT Library | MUC17 BiTE antibody x 12CO-scFc | Epitope cluster | Affinity (Biacore) huMUC17 [nM] | NUGC-4 & unstim huPBMC | NUG/Kdhu | VH_VL |
|---|---|---|---|---|---|---|
| 1a | 2-D11 CC | E2/E5A/((E5B)) / TR2/TR3 | 0,70 | 21,5 | 30,7 | 3_l3 |
| 1c | 8-E3 CC | E2/E5A/((E5B)) / TR2/TR3 | 2,40 | 35,1 | 146,2 | 3_l3 |
| 1c | 32-G6 CC | E2/E5A/(E5B) / TR2/TR3 | 0,40 | 49,0 | 122,5 | 3l3 |
| 1c | 2-C2 CC | E2/E5A/(E5B) / TR2/TR3 | 0,50 | 32,4 | 64,8 | 3l3 |
| 4a | 8-A7 CC | E2/E5A/((E5B)) / TR2/TR3 | 1,10 | 9,9 | 9,0 | 4l3 |
| 4a | 8-B7 CC | E2/E5A/((E5B)) / TR2/TR3 | 1,20 | 17,2 | 14,3 | 4l3 |
| 4a | 8-B8 CC | E2/E5A/((E5B)) / TR2/TR3 | 1,00 | 20,6 | 20,6 | 4l3 |
| 4a | 8-C7 CC | E2/E5A/((E5B)) / TR2/TR3 | 1,10 | 19,9 | 18,1 | 4l3 |
| 4a | 8=H8 CC | E2/E5A/E5B / TR2/TR3 | 1,40 | 17,1 | 12,2 | 4l3 |
| 4a | 8-D7 CC | E2/E5A/E5B / TR2/TR3 | 1,20 | 21,3 | 17,8 | 4l3 |
| 4a | 4-E7 CC | E2/E5A/E5B / TR2/TR3 | 2,20 | 20,3 | 9,2 | 4l3 |
| 4a | 8-F9 CC | E2/E5A/E5B / TR2/TR3 | 1,10 | 13,6 | 12,4 | 4l3 |
| 4a | 1-A8 CC | E2/E5A/E5B / TR2/TR3 | 1,00 | 8,0 | 8,0 | 4l3 |
| 4b | 8-H9 CC | E2/E5A/E5B / TR2/TR3 | 5,00 | 39,2 | 7,8 | 4l3 |
| 4b | 1-B6 CC | E2/E5A/E5B / TR2/TR3 | 3,40 | 27,5 | 8,1 | 4l3 |
| 5a | 8-F11 CC | E2/E5A/E5B / TR2/TR3 | 64,90 | 442 | 6,8 | 4l3 |
| 6 | 6-B12 CC | E2/(E5A)/E5B / TR2/(TR3) | 0,10 | 142 | 1419,5 | 3k3 |
| 6 | 7-G6 CC | E2/(E5A)/E5B / TR2/(TR3) | 0,40 | 247 | 616,5 | 3k3 |
| 6 | 0-F6 CC | E2/E5A/E5B / TR2 | 0,80 | 468 | 610,5 | 3k3 |
| 6 | 0-F9 CC | E2/E5A/E5B / TR2/(TR3) | 0,50 | 224 | 448,1 | 3k3 |
| 6 | 1-E9 CC | E2/E5A/E5B / TR2/((TR3)) | 0,30 | 122 | 408,0 | 3k3 |
| 6 | 1-H2 CC | E2/E5A/E5B / TR2/((TR3)) | 0,80 | 258 | 323,1 | 3k3 |
| 6 | 02-E7 CC | E2/E5A/E5B TR2/((TR3)) | 0,20 | 291 | 1454,2 | 3k3 |
| 6 | 2-F7 CC | E2/E5A/E5B / TR2/((TR3)) | 0,40 | 152 | 379,3 | 3k3 |
| 6 | 5-H4 CC | E2/E5A/E5B / TR2 | 2,50 | 833 | 333,2 | 3k3 |
| 6 | 0-E5 CC | E2/E5A/E5B TR2/((TR3)) | 0,20 | 190 | 950,0 | 3k3 |
| 6 | 3-C10 CC | E2/E5A/E5B / TR2 | 0,60 | 327 | 545,0 | 3k3 |
| 7 | 8-H5 CC | E2/E5A/E5B / TR2 | 1,30 | 1303 | 1002,5 | 3k3 |
| 7 | 92-C12 CC | E2/E5A/E5B / TR2 | 3,30 | 1417 | 429,4 | 3k3 |
| 7 | 2-A3 CC | E2/E5A/E5B / TR2 | 1,70 | 637 | 374,7 | 3k3 |
| 8 | 4-C3 CC | E2/((E5A))/E5B / TR2 | 9,10 | 2975 | 326,9 | 3k3 |
| 8 | 92-G6 CC | E2/E5A/E5B / TR2 | 6,30 | 1750 | 279,4 | 3k3 |
| 8 | 4-C11 CC | E2/E5A/E5B / TR2 | 7,60 | 2445 | 322,2 | 3k3 |
| 8 | 4-C4 CC | E2/E5A/E5B / TR2 | 0,60 | 422 | 711,7 | 3k3 |
| 8 | 4-B6 CC | E2/E5A/E5B / TR2 | 4,70 | 2374 | 483,8 | 3k3 |
| 9 | 9-C2 CC | E2/E5A/E5B / TR2/TR3 | 2,40 | 154 | 64,2 | 3l3 |
| 9 | 1-B10 CC | E2/E5A/E5B / TR2/TR3 | 33,10 | 1147 | 34,7 | 3l3 |
| 9 | 4-B1 CC | E2/E5A/E5B / TR2/TR3 | 19,70 | 1117 | 56,7 | 3l3 |
| 9 | 4-F6 CC | E2/E5A/E5B / TR2/TR3 | 19,20 | 392 | 20,4 | 3l3 |
| 9 | 4-G4 CC | E2/E5A/E5B / TR2/TR3 | 3,20 | 135 | 42,2 | 3l3 |
| 9 | 4-A8 CC | E2/E5A/E5B / TR2/TR3 | 12,50 | 753 | 60,2 | 3l3 |
| 9 | 4-B10 CC | E2/E5A/E5B / TR2/TR3 | 15,30 | 795 | 52,0 | 3l3 |
| 9 | 4-H11 CC | E2/E5A/E5B / TR2/TR3 | 3,40 | 120 | 35,3 | 3l3 |
| 9 | 4-H2 CC | E2/E5A/E5B / TR2/TR3 | 2,60 | 119 | 45,8 | 3l3 |
| 10 | 5-H1 CC | E2/E5A/E5B / TR2/TR3 | 38,70 | 318 | 8,2 | 4l3 |

(E5A) binding is affected  ((E5A)) binding is nearly completely abolished

BISPECIFIC ANTIBODY CONSTRUCT DIRECTED TO MUC17 AND CD3

TECHNICAL FIELD

This invention relates to products and methods of biotechnology, in particular to bispecific antibodies constructs, their preparation and their use.

BACKGROUND

Among the most quickly and promisingly developing therapeutics are protein-based pharmaceuticals which already have a significant role in almost every field of medicine and are among the fastest growing therapeutic agents in (pre)clinical development and as commercial products (Leader, Nature Reviews Drug Discovery 2008 Jan. 7, 21-39). In comparison to small chemical drugs, protein pharmaceuticals have high specificity and activity at relatively low concentrations, and typically provide for therapy of high impact diseases such as various cancers, autoimmune diseases, and metabolic disorders (Roberts, Trends Biotechnol. 2014 July; 32(7):372-80, Wang, Int J Pharm. 1999 Aug. 20; 185(2):129-88).

Such new protein-based pharmaceuticals comprise, for example, bispecific (monoclonal) antibodies which typically can simultaneously bind to two different types of antigen. They are known in several structural formats, and current applications have been explored for cancer immunotherapy and drug delivery (Fan, Gaowei; Wang, Zujian; Hao, Mingju; Li, Jinming (2015). "Bispecific antibodies and their applications". Journal of Hematology & Oncology. 8: 130).

Bispecific antibodies can be IgG-like, i.e. full length bispecific antibodies, or non-IgG-like bispecific antibodies, which are not full-length antibody constructs. Full length bispecific antibodies typically retain the traditional monoclonal antibody (mAb) structure of two Fab arms and one Fc region, except the two Fab sites bind different antigens. Non full-length bispecific antibodies can lack an Fc region entirely. These include chemically linked Fabs, consisting of only the Fab regions, and various types of bivalent and trivalent single-chain variable fragments (scFvs). There are also fusion proteins mimicking the variable domains of two antibodies. An example of such a format is the bi-specific T-cell engager (BiTE®) (Yang, Fa; Wen, Weihong; Qin, Weijun (2016). "Bispecific Antibodies as a Development Platform for New Concepts and Treatment Strategies". International Journal of Molecular Sciences. 18 (1): 48).

Bispecific antibody derived molecules such as BiTE® antibody constructs are recombinant protein constructs made from two flexibly linked antibody derived binding domains. One binding domain of BiTE® antibody constructs is specific for a selected tumor-associated surface antigen on target cells; the second binding domain is specific for CD3, a subunit of the T cell receptor complex on T cells. By their particular design, BiTE® antibody constructs are uniquely suited to transiently connect T cells with target cells and, at the same time, potently activate the inherent cytolytic potential of T cells against target cells. An important further development of the first generation of BiTE® antibody constructs (see WO 99/54440 and WO 2005/040220) developed into the clinic as AMG 103 and AMG 110 was the provision of bispecific antibody constructs binding to a context independent epitope at the N-terminus of the CD3E chain (WO 2008/119567). BiTE® antibody constructs binding to this elected epitope do not only show cross-species specificity for the human and the *Macaca*, or *Callithrix jacchus*, *Saguinus oedipus* or *Saimiri sciureus* CD3ε chain, but also, due to recognizing this specific epitope (instead of previously described epitopes of CD3 binders in bispecific T cell engaging molecules), do not demonstrate unspecific activation of T cells to the same degree as observed for the previous generation of T cell engaging antibodies. This reduction in T cell activation was connected with less or reduced T cell redistribution in patients, the latter being identified as a risk for side effects, e.g. in pasotuximab.

Antibody constructs as described in WO 2008/119567 are characterized by rapid clearance from the body; thus, while they are able to reach most parts of the body rapidly, their in vivo applications may be limited by their brief persistence in vivo. On the other hand, their concentration in the body can be adapted and fine-tuned at short notice. Prolonged administration by continuous intravenous infusion is used to achieve therapeutic effects because of the short in vivo half-life of this small, single chain molecule. However, now bispecific antibody constructs are available which have more favorable pharmacokinetic properties, including a longer half-life. An increased half-life is generally useful in in vivo applications of immunoglobulins, especially antibodies and most especially antibody fragments or constructs of small size, e.g. in the interest of patient compliance.

Mucins have been identified as interesting markers for inflammatory and cancerous diseases. Mucins are high molecular weight glycoproteins that are characterized by high levels of O-glycosylation at serine and threonine residues within tandem repeat domains (Johansson and Hansson, Nat. Rev. Immunology 2016). There are at least 20 mucin family members, including secreted proteins and transmembrane proteins, which are expressed by epithelial cells in different tissues (Corfield, Biochim. Biophys. Acta 2013). The main function of mucins is in the structure and regulation of the mucosal layer that forms a protective barrier between epithelial cells and the environment (Hollingsworth and Swanson, Nat. Rev. Cancer 2004; Hattrup and Gendler, Annu. Rev. Physiol. 2008). Transmembrane mucins also play a role in cellular signaling, including regulation of proliferation and apoptosis, and in tumorigenesis (Hollingsworth and Swanson, Nat. Rev. Cancer 2004). Among the mucins, Mucin 17 (MUC17) is a transmembrane mucin that was initially identified by its homology to MUC3 (Gum et al., Biochem. Biophys. Res. Comm 2002).

Analysis of the complete coding sequence of MUC17 revealed that it has a large extracellular domain composed of a central region of 61 tandem repeats, an epidermal growth factor (EGF) domain, a sea urchin sperm protein, enterokinase and agrin (SEA) domain, and a second EGF domain. The SEA domain contains a putative cleavage site that is conserved in other mucins (Moniaux et al., J. Biol. Chem. 2006). MUC17 is a single-pass transmembrane protein with an 80-amino acid cytoplasmic tail that is intracellular (Moniaux et al., J. Biol. Chem. 2006). The expression of MUC17 in healthy adults is restricted to the apical surface of enterocytes, or mature absorptive epithelial cells, that line the intestine (Moniaux et al., J. Biol. Chem. 2006; Johanasson and Hansson, Nat. Rev. Immunology 2016). MUC17 is also expressed by the stomach and pancreas (Moniaux et al., J. Biol. Chem. 2006; Moehle et al., J. Mol. Med. 2006). The biological function of MUC17 is considered to be the maintenance of mucosal barrier integrity in the intestinal tract, such as by mucosal restitution (Luu et al., Int. J. Biochem. Cell Biol. 2010; Resta-Lenert et al., Am. J. Physiology 2011; Johanasson and Hansson, Nat. Rev. Immunology 2016).

MUC17 is aberrantly expressed in some cancers. MUC17 mRNA was shown to be expressed in one pancreatic cancer cell line and three colon cancer cell lines (Gum et al. 2002) Immunohistochemistry studies confirmed expression of the MUC17 protein in pancreatic cancer ((Moniaux et al. 2006). In colon cancer, however, MUC17 protein expression was shown to be decreased (Senapati et al., J. Clin. Pathol. 2010). Nevertheless, the expression patterns of MUC17 make it a potential target for the treatment of different forms of malignancy.

SUMMARY

In view of the conflicting implications in the literature with regard to MUC17 as a potential target for which pathological condition, it is the object of the present invention to clearly identify specific conditions associated with MUC17 upregulation and to provide bispecific antibody constructs, such as T cell engaging molecules, which are specifically suitable to bind MUC17 in a MUC17-associated condition, preferably for use in the treatment of said specific conditions. Accordingly, the present invention provides an antibody construct characterized by comprising a first domain binding to MUC17, a second domain binding to an extracellular epitope of the human and non-human, e.g. Macaca CD3ε chain, and preferably a third domain, which is a specific Fc modality. Moreover, the invention provides a polynucleotide encoding the antibody construct, a vector comprising this polynucleotide, and host cells expressing the construct and a pharmaceutical composition comprising the same.

In a first aspect, it is envisaged in the context of the present invention to provide an antibody construct comprising:
  a first domain which binds to MUC17 and
  a second domain which binds to an extracellular epitope of the human and the Macaca CD3ε chain.

Within said aspect, it is further envisaged in the context of the present invention that the antibody construct comprises a third domain which comprises two polypeptide monomers, each comprising a hinge, a CH2 domain and a CH3 domain, wherein said two polypeptide monomers are fused to each other via a peptide linker.

Within said aspect, it is further envisaged in the context of the present invention to provide an antibody construct which is a single chain antibody construct.

Within said aspect, it is also envisaged in the context of the present invention to provide an antibody construct wherein said third domain comprises in an amino to carboxyl order: hinge-CH2-CH3-linker-hinge-CH2-CH3.

Within said aspect, it is further envisaged in the context of the present invention to provide an antibody construct wherein each of said polypeptide monomers has an amino acid sequence that is at least 90% identical to a sequence selected from the group from the group consisting of: SEQ ID NO: 17-24.

Within said aspect, it is also envisaged in the context of the present invention to provide an antibody construct, wherein each of said polypeptide monomers has an amino acid sequence selected from SEQ ID NO: 17-24.

Within said aspect, it is further envisaged in the context of the present invention to provide an antibody construct, wherein the CH2 domain comprises an intra domain cysteine disulfide bridge.

Within said aspect, it is also envisaged in the context of the present invention to provide an antibody construct, wherein (i) the first domain comprises two antibody variable domains and the second domain comprises two antibody variable domains;
(ii) the first domain comprises one antibody variable domain and the second domain comprises two antibody variable domains;
(iii) the first domain comprises two antibody variable domains and the second domain comprises one antibody variable domain; or
(iv) the first domain comprises one antibody variable domain and the second domain comprises one antibody variable domain.

Within said aspect, it is also envisaged in the context of the present invention to provide an antibody construct, wherein the first and second domain are fused to the third domain via a peptide linker.

Within said aspect, it is also envisaged in the context of the present invention to provide an antibody construct, wherein the antibody construct comprises in an amino to carboxyl order:
  (a) the first domain;
  (b) a peptide linker having an amino acid sequence selected from the group consisting of SEQ ID NOs: 1-3;
  (c) the second domain Within said aspect, it is also envisaged in the context of the present invention to provide an antibody construct, wherein the antibody construct in addition to (a) to (c) comprises in an amino to carboxyl order:
  (d) a peptide linker having an amino acid sequence selected from the group consisting of SEQ ID NOs: 1, 2, 3, 9, 10, 11 and 12;
  (e) the first polypeptide monomer of the third domain;
  (f) a peptide linker having an amino acid sequence selected from the group consisting of SEQ ID NOs: 5, 6, 7 and 8; and
  (g) the second polypeptide monomer of the third domain Within said aspect, it is further envisaged in the context of the present invention to provide an antibody construct, wherein the first domain of the antibody construct binds to an epitope within MUC17 which corresponds to SEQ ID NO. 528 (aa 4171 to 4296 according to uniprot Q685J3 numbering).

Within said aspect, it is also envisaged in the context of the present invention to provide an antibody construct, wherein the first domain of the antibody construct binds to an epitope within MUC17 which corresponds to SEQ ID NO. 529 (aa 4184 to 4291 according to uniprot Q685J3 numbering).

Within said aspect, it is further envisaged in the context of the present invention to provide an antibody construct, wherein the first domain of the antibody construct binds to an epitope within MUC17 which corresponds to SEQ ID NO. 530 (aa 4131 to 4243 according to uniprot Q685J3 numbering).

Within said aspect, it is also envisaged in the context of the present invention to provide an antibody construct, wherein the first domain of the antibody construct binds to an epitope within MUC17 which corresponds to SEQ ID NO. 531 (aa 4244 to 4389 according to uniprot Q685J3 numbering).

Within said aspect, it is further envisaged in the context of the present invention to provide an antibody construct, wherein the first domain of the antibody construct binds to an epitope within MUC17 which corresponds to SEQ ID NO. 530 (aa 4131 to 4243 according to uniprot Q685J3 numbering) but not to an epitope within MUC17 which corresponds to SEQ ID NO. 531 (aa 4244 to 4389 according to uniprot Q685J3 numbering).

Within said aspect, it is also envisaged in the context of the present invention to provide an antibody construct, wherein the first domain of the antibody construct binds to an epitope within MUC17 which corresponds to SEQ ID NO. 532 (aa 4171 to 4390 according to uniprot Q685J3 numbering) or SEQ ID NO. 533 (aa 4184 to 4390 according to uniprot Q685J3 numbering) but not to an epitope within MUC17 which corresponds to SEQ ID NO. 534 (aa 4291 to 4390 according to uniprot Q685J3 numbering) or to an epitope within MUC17 which corresponds to SEQ ID NO. 535 (aa 4341 to 4390 according to uniprot Q685J3 numbering).

Within said aspect, it is further envisaged in the context of the present invention to provide an antibody construct, wherein the VH VL arrangement is characterized as 4 lambda 3. The nomenclature is known in the art.

Within said aspect, it is further envisaged in the context of the present invention to provide an antibody construct, wherein the ratio between cytotoxicity and binding affinity $(EC_{50}/K_D)*1000$ is below 250, wherein the cytotoxicity is indicated in pM and determined in NUGC-4 cells as target cells and huPBMC as effector cells, and wherein the binding affinity is indicated in nM and determined by a surface plasmon resonance (SPR) assay, such as a Biacore assay. The factor 1000 has been introduced for better readability considering the different dimension between typical $EC_{50}$ and $K_D$ values.

Within said aspect, it is also envisaged in the context of the present invention to provide an antibody construct, wherein the ratio between cytotoxicity and binding affinity $(EC_{50}/K_D)*1000$ is below 125, wherein the cytotoxicity is indicated in pM and determined, e.g., in NUGC-4 cells as target cells and huPBMC as effector cells, and wherein the binding affinity is indicated in nM and determined, e.g., by a surface plasmon resonance-based assay.

Within said aspect, it is further envisaged in the context of the present invention to provide an antibody construct, wherein the ratio between cytotoxicity and binding affinity $(EC_{50}/K_D)*1000$ is below 21, wherein the cytotoxicity is indicated in pM and determined, e.g., in NUGC-4 cells as target cells and huPBMC as effector cells, and wherein the binding affinity is indicated in nM and determined by a surface plasmon resonance-based assay. Preferably, cytotoxicity ($EC_{50}$) is <100 pM and the binding affinity ($K_D$) is <25 nM.

Within said aspect, it is also envisaged in the context of the present invention to provide an antibody construct, wherein the first binding domain comprises a VH region comprising CDR-H 1, CDR-H2 and CDR-H3 selected from:
(a) CDR-H1 as depicted in SEQ ID NO. 33, CDR-H2 as depicted in SEQ ID NO. 34 and CDR-H3 as depicted in SEQ ID NO. 35;
(b) CDR-H1 as depicted in SEQ ID NO. 44, CDR-H2 as depicted in SEQ ID NO. 45 and CDR-H3 as depicted in SEQ ID NO. 46;
(c) CDR-H1 as depicted in SEQ ID NO. 55, CDR-H2 as depicted in SEQ ID NO. 56 and CDR-H3 as depicted in SEQ ID NO. 57;
(d) CDR-H1 as depicted in SEQ ID NO. 66, CDR-H2 as depicted in SEQ ID NO. 67 and CDR-H3 as depicted in SEQ ID NO. 68;
(e) CDR-H1 as depicted in SEQ ID NO. 77, CDR-H2 as depicted in SEQ ID NO. 78 and CDR-H3 as depicted in SEQ ID NO. 79;
(f) CDR-H1 as depicted in SEQ ID NO. 88, CDR-H2 as depicted in SEQ ID NO. 89 and CDR-H3 as depicted in SEQ ID NO. 90;
(g) CDR-H1 as depicted in SEQ ID NO. 99, CDR-H2 as depicted in SEQ ID NO. 100 and CDR-H3 as depicted in SEQ ID NO. 101;
(h) CDR-H1 as depicted in SEQ ID NO. 110, CDR-H2 as depicted in SEQ ID NO. 111 and CDR-H3 as depicted in SEQ ID NO. 112;
(i) CDR-H1 as depicted in SEQ ID NO. 121, CDR-H2 as depicted in SEQ ID NO. 122 and CDR-H3 as depicted in SEQ ID NO. 123;
(j) CDR-H1 as depicted in SEQ ID NO. 132, CDR-H2 as depicted in SEQ ID NO. 133 and CDR-H3 as depicted in SEQ ID NO. 134;
(k) CDR-H1 as depicted in SEQ ID NO. 143, CDR-H2 as depicted in SEQ ID NO. 144 and CDR-H3 as depicted in SEQ ID NO. 145;
(l) CDR-H1 as depicted in SEQ ID NO. 154, CDR-H2 as depicted in SEQ ID NO. 155 and CDR-H3 as depicted in SEQ ID NO. 156;
(m) CDR-H1 as depicted in SEQ ID NO. 165, CDR-H2 as depicted in SEQ ID NO. 166 and CDR-H3 as depicted in SEQ ID NO. 167;
(n) CDR-H1 as depicted in SEQ ID NO. 176, CDR-H2 as depicted in SEQ ID NO. 177 and CDR-H3 as depicted in SEQ ID NO. 178;
(o) CDR-H1 as depicted in SEQ ID NO. 187, CDR-H2 as depicted in SEQ ID NO. 188 and CDR-H3 as depicted in SEQ ID NO. 189;
(p) CDR-H1 as depicted in SEQ ID NO. 198, CDR-H2 as depicted in SEQ ID NO. 199 and CDR-H3 as depicted in SEQ ID NO. 200;
(q) CDR-H1 as depicted in SEQ ID NO. 209, CDR-H2 as depicted in SEQ ID NO. 210 and CDR-H3 as depicted in SEQ ID NO. 211;
(r) CDR-H1 as depicted in SEQ ID NO. 220, CDR-H2 as depicted in SEQ ID NO. 221 and CDR-H3 as depicted in SEQ ID NO. 222;
(s) CDR-H1 as depicted in SEQ ID NO. 231, CDR-H2 as depicted in SEQ ID NO. 232 and CDR-H3 as depicted in SEQ ID NO. 233;
(t) CDR-H1 as depicted in SEQ ID NO. 242, CDR-H2 as depicted in SEQ ID NO. 243 and CDR-H3 as depicted in SEQ ID NO. 244;
(u) CDR-H1 as depicted in SEQ ID NO. 253, CDR-H2 as depicted in SEQ ID NO. 254 and CDR-H3 as depicted in SEQ ID NO. 255;
(v) CDR-H1 as depicted in SEQ ID NO. 264, CDR-H2 as depicted in SEQ ID NO. 265 and CDR-H3 as depicted in SEQ ID NO. 266;
(w) CDR-H1 as depicted in SEQ ID NO. 275, CDR-H2 as depicted in SEQ ID NO. 276 and CDR-H3 as depicted in SEQ ID NO. 276;
(x) CDR-H1 as depicted in SEQ ID NO. 286, CDR-H2 as depicted in SEQ ID NO. 287 and CDR-H3 as depicted in SEQ ID NO. 288;
(y) CDR-H1 as depicted in SEQ ID NO. 297, CDR-H2 as depicted in SEQ ID NO. 298 and CDR-H3 as depicted in SEQ ID NO. 299;
(z) CDR-H1 as depicted in SEQ ID NO. 308, CDR-H2 as depicted in SEQ ID NO. 309 and CDR-H3 as depicted in SEQ ID NO. 310;
(aa) CDR-H1 as depicted in SEQ ID NO. 319, CDR-H2 as depicted in SEQ ID NO. 320 and CDR-H3 as depicted in SEQ ID NO. 321;

(ab) CDR-H1 as depicted in SEQ ID NO. 330, CDR-H2 as depicted in SEQ ID NO. 331 and CDR-H3 as depicted in SEQ ID NO. 332;
(ac) CDR-H1 as depicted in SEQ ID NO. 341, CDR-H2 as depicted in SEQ ID NO. 342 and CDR-H3 as depicted in SEQ ID NO. 343;
(ad) CDR-H1 as depicted in SEQ ID NO. 352, CDR-H2 as depicted in SEQ ID NO. 353 and CDR-H3 as depicted in SEQ ID NO. 354;
(ae) CDR-H1 as depicted in SEQ ID NO. 363, CDR-H2 as depicted in SEQ ID NO. 364 and CDR-H3 as depicted in SEQ ID NO. 365;
(af) CDR-H1 as depicted in SEQ ID NO. 374, CDR-H2 as depicted in SEQ ID NO. 375 and CDR-H3 as depicted in SEQ ID NO. 376;
(ag) CDR-H1 as depicted in SEQ ID NO. 385, CDR-H2 as depicted in SEQ ID NO. 386 and CDR-H3 as depicted in SEQ ID NO. 386;
(ah) CDR-H1 as depicted in SEQ ID NO. 396, CDR-H2 as depicted in SEQ ID NO. 397 and CDR-H3 as depicted in SEQ ID NO. 398;
(ai) CDR-H1 as depicted in SEQ ID NO. 407, CDR-H2 as depicted in SEQ ID NO. 408 and CDR-H3 as depicted in SEQ ID NO. 409;
(aj) CDR-H1 as depicted in SEQ ID NO. 418, CDR-H2 as depicted in SEQ ID NO. 419 and CDR-H3 as depicted in SEQ ID NO. 420;
(ak) CDR-H1 as depicted in SEQ ID NO. 429, CDR-H2 as depicted in SEQ ID NO. 430 and CDR-H3 as depicted in SEQ ID NO. 431;
(al) CDR-H1 as depicted in SEQ ID NO. 440, CDR-H2 as depicted in SEQ ID NO. 441 and CDR-H3 as depicted in SEQ ID NO. 442;
(am) CDR-H1 as depicted in SEQ ID NO. 451, CDR-H2 as depicted in SEQ ID NO. 452 and CDR-H3 as depicted in SEQ ID NO. 453;
(an) CDR-H1 as depicted in SEQ ID NO. 462, CDR-H2 as depicted in SEQ ID NO. 463 and CDR-H3 as depicted in SEQ ID NO. 464;
(ao) CDR-H1 as depicted in SEQ ID NO. 473, CDR-H2 as depicted in SEQ ID NO. 474 and CDR-H3 as depicted in SEQ ID NO. 475;
(ap) CDR-H1 as depicted in SEQ ID NO. 484, CDR-H2 as depicted in SEQ ID NO. 485 and CDR-H3 as depicted in SEQ ID NO. 486;
(aq) CDR-H1 as depicted in SEQ ID NO. 495, CDR-H2 as depicted in SEQ ID NO. 496 and CDR-H3 as depicted in SEQ ID NO. 497;
(ar) CDR-H1 as depicted in SEQ ID NO. 506, CDR-H2 as depicted in SEQ ID NO. 507 and CDR-H3 as depicted in SEQ ID NO. 508; and
(as) CDR-H1 as depicted in SEQ ID NO. 517, CDR-H2 as depicted in SEQ ID NO. 518 and CDR-H3 as depicted in SEQ ID NO. 519; wherein preferred are
(c) CDR-H1 as depicted in SEQ ID NO. 55, CDR-H2 as depicted in SEQ ID NO. 56 and CDR-H3 as depicted in SEQ ID NO. 57;
(n) CDR-H1 as depicted in SEQ ID NO. 176, CDR-H2 as depicted in SEQ ID NO. 177 and CDR-H3 as depicted in SEQ ID NO. 178;
(ac) CDR-H1 as depicted in SEQ ID NO. 341, CDR-H2 as depicted in SEQ ID NO. 342 and CDR-H3 as depicted in SEQ ID NO. 343; and
(aj) CDR-H1 as depicted in SEQ ID NO. 418, CDR-H2 as depicted in SEQ ID NO. 419 and CDR-H3 as depicted in SEQ ID NO. 420.

Within said aspect, it is also envisaged in the context of the present invention to provide an antibody construct, wherein the first binding domain comprises a VL region comprising CDR-H1, CDR-L2 and CDR-L3 selected from:
(a) CDR-L1 as depicted in SEQ ID NO. 36, CDR-L2 as depicted in SEQ ID NO. 37 and CDR-L3 as depicted in SEQ ID NO. 38;
(b) CDR-L1 as depicted in SEQ ID NO. 47, CDR-L2 as depicted in SEQ ID NO. 48 and CDR-L3 as depicted in SEQ ID NO. 49;
(c) CDR-L1 as depicted in SEQ ID NO. 58, CDR-L2 as depicted in SEQ ID NO. 59 and CDR-L3 as depicted in SEQ ID NO. 60;
(d) CDR-L1 as depicted in SEQ ID NO. 69, CDR-L2 as depicted in SEQ ID NO. 70 and CDR-L3 as depicted in SEQ ID NO. 71;
(e) CDR-L1 as depicted in SEQ ID NO. 80, CDR-L2 as depicted in SEQ ID NO. 81 and CDR-L3 as depicted in SEQ ID NO. 82;
(f) CDR-L1 as depicted in SEQ ID NO. 91, CDR-L2 as depicted in SEQ ID NO. 92 and CDR-L3 as depicted in SEQ ID NO. 93;
(g) CDR-L1 as depicted in SEQ ID NO. 102, CDR-L2 as depicted in SEQ ID NO. 103 and CDR-L3 as depicted in SEQ ID NO. 104;
(h) CDR-L1 as depicted in SEQ ID NO. 113, CDR-L2 as depicted in SEQ ID NO. 114 and CDR-L3 as depicted in SEQ ID NO. 115;
(i) CDR-L1 as depicted in SEQ ID NO. 124, CDR-L2 as depicted in SEQ ID NO. 125 and CDR-L3 as depicted in SEQ ID NO. 126;
(j) CDR-L1 as depicted in SEQ ID NO. 135, CDR-L2 as depicted in SEQ ID NO. 136 and CDR-L3 as depicted in SEQ ID NO. 137;
(k) CDR-L1 as depicted in SEQ ID NO. 146, CDR-L2 as depicted in SEQ ID NO. 147 and CDR-L3 as depicted in SEQ ID NO. 148;
(l) CDR-L1 as depicted in SEQ ID NO. 157, CDR-L2 as depicted in SEQ ID NO. 158 and CDR-L3 as depicted in SEQ ID NO. 159;
(m) CDR-L1 as depicted in SEQ ID NO. 168, CDR-L2 as depicted in SEQ ID NO. 169 and CDR-L3 as depicted in SEQ ID NO. 170;
(n) CDR-L1 as depicted in SEQ ID NO. 179, CDR-L2 as depicted in SEQ ID NO. 180 and CDR-L3 as depicted in SEQ ID NO. 181;
(o) CDR-L1 as depicted in SEQ ID NO. 190, CDR-L2 as depicted in SEQ ID NO. 191 and CDR-L3 as depicted in SEQ ID NO. 192;
(p) CDR-L1 as depicted in SEQ ID NO. 201, CDR-L2 as depicted in SEQ ID NO. 202 and CDR-L3 as depicted in SEQ ID NO. 203;
(q) CDR-L1 as depicted in SEQ ID NO. 212, CDR-L2 as depicted in SEQ ID NO. 213 and CDR-L3 as depicted in SEQ ID NO. 214;
(r) CDR-L1 as depicted in SEQ ID NO. 223, CDR-L2 as depicted in SEQ ID NO. 224 and CDR-L3 as depicted in SEQ ID NO. 225;
(s) CDR-L1 as depicted in SEQ ID NO. 234, CDR-L2 as depicted in SEQ ID NO. 235 and CDR-L3 as depicted in SEQ ID NO. 236;
(t) CDR-L1 as depicted in SEQ ID NO. 245, CDR-L2 as depicted in SEQ ID NO. 246 and CDR-L3 as depicted in SEQ ID NO. 247;
(u) CDR-L1 as depicted in SEQ ID NO. 256, CDR-L2 as depicted in SEQ ID NO. 257 and CDR-L3 as depicted in SEQ ID NO. 258;

(v) CDR-L1 as depicted in SEQ ID NO. 267, CDR-L2 as depicted in SEQ ID NO. 268 and CDR-L3 as depicted in SEQ ID NO. 269;
(w) CDR-L1 as depicted in SEQ ID NO. 278, CDR-L2 as depicted in SEQ ID NO. 279 and CDR-L3 as depicted in SEQ ID NO. 280;
(x) CDR-L1 as depicted in SEQ ID NO. 289, CDR-L2 as depicted in SEQ ID NO. 290 and CDR-L3 as depicted in SEQ ID NO. 291;
(y) CDR-L1 as depicted in SEQ ID NO. 300, CDR-L2 as depicted in SEQ ID NO. 301 and CDR-L3 as depicted in SEQ ID NO. 302;
(z) CDR-L1 as depicted in SEQ ID NO. 311, CDR-L2 as depicted in SEQ ID NO. 312 and CDR-L3 as depicted in SEQ ID NO. 313;
(aa) CDR-L1 as depicted in SEQ ID NO. 322, CDR-L2 as depicted in SEQ ID NO. 323 and CDR-L3 as depicted in SEQ ID NO. 324;
(ab) CDR-L1 as depicted in SEQ ID NO. 333, CDR-L2 as depicted in SEQ ID NO. 334 and CDR-L3 as depicted in SEQ ID NO. 335;
(ac) CDR-L1 as depicted in SEQ ID NO. 344, CDR-L2 as depicted in SEQ ID NO. 345 and CDR-L3 as depicted in SEQ ID NO. 346;
(ad) CDR-L1 as depicted in SEQ ID NO. 355, CDR-L2 as depicted in SEQ ID NO. 356 and CDR-L3 as depicted in SEQ ID NO. 357;
(ae) CDR-L1 as depicted in SEQ ID NO. 366, CDR-L2 as depicted in SEQ ID NO. 367 and CDR-L3 as depicted in SEQ ID NO. 368;
(af) CDR-L1 as depicted in SEQ ID NO. 377, CDR-L2 as depicted in SEQ ID NO. 378 and CDR-L3 as depicted in SEQ ID NO. 379;
(ag) CDR-L1 as depicted in SEQ ID NO. 388, CDR-L2 as depicted in SEQ ID NO. 389 and CDR-L3 as depicted in SEQ ID NO. 390;
(ah) CDR-L1 as depicted in SEQ ID NO. 399, CDR-L2 as depicted in SEQ ID NO. 400 and CDR-L3 as depicted in SEQ ID NO. 401;
(ai) CDR-L1 as depicted in SEQ ID NO. 410, CDR-L2 as depicted in SEQ ID NO. 411 and CDR-L3 as depicted in SEQ ID NO. 412;
(aj) CDR-L1 as depicted in SEQ ID NO. 421, CDR-L2 as depicted in SEQ ID NO. 422 and CDR-L3 as depicted in SEQ ID NO. 423;
(ak) CDR-L1 as depicted in SEQ ID NO. 432, CDR-L2 as depicted in SEQ ID NO. 433 and CDR-L3 as depicted in SEQ ID NO. 434;
(al) CDR-L1 as depicted in SEQ ID NO. 443, CDR-L2 as depicted in SEQ ID NO. 444 and CDR-L3 as depicted in SEQ ID NO. 445;
(am) CDR-L1 as depicted in SEQ ID NO. 454, CDR-L2 as depicted in SEQ ID NO. 455 and CDR-L3 as depicted in SEQ ID NO. 456;
(an) CDR-L1 as depicted in SEQ ID NO. 465, CDR-L2 as depicted in SEQ ID NO. 466 and CDR-L3 as depicted in SEQ ID NO. 467;
(ao) CDR-L1 as depicted in SEQ ID NO. 476, CDR-L2 as depicted in SEQ ID NO. 477 and CDR-L3 as depicted in SEQ ID NO. 478;
(ap) CDR-L1 as depicted in SEQ ID NO. 487, CDR-L2 as depicted in SEQ ID NO. 488 and CDR-L3 as depicted in SEQ ID NO. 489;
(aq) CDR-L1 as depicted in SEQ ID NO. 498, CDR-L2 as depicted in SEQ ID NO. 499 and CDR-L3 as depicted in SEQ ID NO. 500;
(ar) CDR-L1 as depicted in SEQ ID NO. 509, CDR-L2 as depicted in SEQ ID NO. 510 and CDR-L3 as depicted in SEQ ID NO. 511; and
(as) CDR-L1 as depicted in SEQ ID NO. 520, CDR-L2 as depicted in SEQ ID NO. 521 and CDR-L3 as depicted in SEQ ID NO. 522; wherein preferred are
(c) CDR-L1 as depicted in SEQ ID NO. 58, CDR-L2 as depicted in SEQ ID NO. 59 and CDR-L3 as depicted in SEQ ID NO. 60;
(n) CDR-L1 as depicted in SEQ ID NO. 179, CDR-L2 as depicted in SEQ ID NO. 180 and CDR-L3 as depicted in SEQ ID NO. 181;
(ac) CDR-L1 as depicted in SEQ ID NO. 344, CDR-L2 as depicted in SEQ ID NO. 345 and CDR-L3 as depicted in SEQ ID NO. 346; and
(aj) CDR-L1 as depicted in SEQ ID NO. 421, CDR-L2 as depicted in SEQ ID NO. 422 and CDR-L3 as depicted in SEQ ID NO. 423.

Within said aspect, it is also envisaged in the context of the present invention to provide an antibody construct, wherein the first binding domain comprises a VL region and a VH region selected from the group consisting of:
(a) a VL region as depicted in SEQ ID NO. 40 and a VH region as depicted in SEQ ID NO. 39;
(b) a VL region as depicted in SEQ ID NO. 51 and a VH region as depicted in SEQ ID NO. 50;
(c) a VL region as depicted in SEQ ID NO. 62 and a VH region as depicted in SEQ ID NO. 61;
(d) a VL region as depicted in SEQ ID NO. 73 and a VH region as depicted in SEQ ID NO. 72;
(e) a VL region as depicted in SEQ ID NO. 84 and a VH region as depicted in SEQ ID NO. 83;
(f) a VL region as depicted in SEQ ID NO. 95 and a VH region as depicted in SEQ ID NO. 94;
(g) a VL region as depicted in SEQ ID NO. 106 and a VH region as depicted in SEQ ID NO. 105;
(h) a VL region as depicted in SEQ ID NO. 117 and a VH region as depicted in SEQ ID NO. 116;
(i) a VL region as depicted in SEQ ID NO. 128 and a VH region as depicted in SEQ ID NO. 127;
(j) a VL region as depicted in SEQ ID NO. 139 and a VH region as depicted in SEQ ID NO. 138;
(k) a VL region as depicted in SEQ ID NO. 150 and a VH region as depicted in SEQ ID NO. 149;
(l) a VL region as depicted in SEQ ID NO. 161 and a VH region as depicted in SEQ ID NO. 160;
(m) a VL region as depicted in SEQ ID NO. 172 and a VH region as depicted in SEQ ID NO. 171;
(n) a VL region as depicted in SEQ ID NO. 183 and a VH region as depicted in SEQ ID NO. 182;
(o) a VL region as depicted in SEQ ID NO. 194 and a VH region as depicted in SEQ ID NO. 193;
(p) a VL region as depicted in SEQ ID NO. 205 and a VH region as depicted in SEQ ID NO. 204;
(q) a VL region as depicted in SEQ ID NO. 216 and a VH region as depicted in SEQ ID NO. 215;
(r) a VL region as depicted in SEQ ID NO. 227 and a VH region as depicted in SEQ ID NO. 226;
(s) a VL region as depicted in SEQ ID NO. 238 and a VH region as depicted in SEQ ID NO. 237;
(t) a VL region as depicted in SEQ ID NO. 249 and a VH region as depicted in SEQ ID NO. 248;
(u) a VL region as depicted in SEQ ID NO. 260 and a VH region as depicted in SEQ ID NO. 259;
(v) a VL region as depicted in SEQ ID NO. 271 and a VH region as depicted in SEQ ID NO. 270;

(w) a VL region as depicted in SEQ ID NO. 282 and a VH region as depicted in SEQ ID NO. 281;
(x) a VL region as depicted in SEQ ID NO. 293 and a VH region as depicted in SEQ ID NO. 292;
(y) a VL region as depicted in SEQ ID NO. 304 and a VH region as depicted in SEQ ID NO. 303;
(z) a VL region as depicted in SEQ ID NO. 315 and a VH region as depicted in SEQ ID NO. 314;
(aa) a VL region as depicted in SEQ ID NO. 326 and a VH region as depicted in SEQ ID NO. 325;
(ab) a VL region as depicted in SEQ ID NO. 337 and a VH region as depicted in SEQ ID NO. 336;
(ac) a VL region as depicted in SEQ ID NO. 348 and a VH region as depicted in SEQ ID NO. 347;
(ad) a VL region as depicted in SEQ ID NO. 359 and a VH region as depicted in SEQ ID NO. 358;
(ae) a VL region as depicted in SEQ ID NO. 370 and a VH region as depicted in SEQ ID NO. 369;
(af) a VL region as depicted in SEQ ID NO. 381 and a VH region as depicted in SEQ ID NO. 380;
(ag) a VL region as depicted in SEQ ID NO. 392 and a VH region as depicted in SEQ ID NO. 391;
(ah) a VL region as depicted in SEQ ID NO. 403 and a VH region as depicted in SEQ ID NO. 402;
(ai) a VL region as depicted in SEQ ID NO. 414 and a VH region as depicted in SEQ ID NO. 413;
(aj) a VL region as depicted in SEQ ID NO. 425 and a VH region as depicted in SEQ ID NO. 424;
(ak) a VL region as depicted in SEQ ID NO. 436 and a VH region as depicted in SEQ ID NO. 435;
(al) a VL region as depicted in SEQ ID NO. 447 and a VH region as depicted in SEQ ID NO. 446;
(am) a VL region as depicted in SEQ ID NO. 458 and a VH region as depicted in SEQ ID NO. 457;
(an) a VL region as depicted in SEQ ID NO. 469 and a VH region as depicted in SEQ ID NO. 468;
(ao) a VL region as depicted in SEQ ID NO. 480 and a VH region as depicted in SEQ ID NO. 479;
(ap) a VL region as depicted in SEQ ID NO. 491 and a VH region as depicted in SEQ ID NO. 490;
(aq) a VL region as depicted in SEQ ID NO. 502 and a VH region as depicted in SEQ ID NO. 501;
(ar) a VL region as depicted in SEQ ID NO. 513 and a VH region as depicted in SEQ ID NO. 512; and
(as) a VL region as depicted in SEQ ID NO. 524 and a VH region as depicted in SEQ ID NO. 523.

Within said aspect, it is further envisaged in the context of the present invention to provide an antibody construct, wherein the antibody construct comprises a sequence selected from an amino acid sequence as depicted in any of SEQ ID NOs: 41, 52, 63, 74, 85, 96, 107, 118, 129, 140, 151, 162, 173, 184, 195, 206, 217, 228, 239, 250, 261, 272, 283, 294, 305, 316, 327, 338, 349, 360, 371, 382, 393, 404, 415, 426, 437, 448, 459, 470, 481, 492, 503, 514, and 525.

Within said aspect, it is also envisaged in the context of the present invention to provide an antibody construct, wherein the antibody construct comprises in an amino to carboxyl order:
(a) the first domain having an amino acid sequence selected from the group consisting of SEQ ID NOs: 41, 52, 63, 74, 85, 96, 107, 118, 129, 140, 151, 162, 173, 184, 195, 206, 217, 228, 239, 250, 261, 272, 283, 294, 305, 316, 327, 338, 349, 360, 371, 382, 393, 404, 415, 426, 437, 448, 459, 470, 481, 492, 503, 514, and 525;
(b) a peptide linker having an amino acid sequence selected from the group consisting of SEQ ID NOs: 1-3;
(c) the second domain having an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567 (SEQ ID NOs: 586-605 herein) or as depicted in SEQ ID NO: 15; and
(d) a peptide linker having an amino acid sequence selected from the group consisting of SEQ ID NOs: 1, 2, 3, 9, 10, 11 and 12;

Within said aspect, it is also envisaged in the context of the present invention to provide an antibody construct, wherein the antibody construct further comprises in addition to (a) to (d) an amino to carboxyl order:
(e) the first polypeptide monomer of the third domain having a polypeptide sequence selected from the group consisting of SEQ ID NOs: 17-24;
(f) a peptide linker having an amino acid sequence selected from the group consisting of SEQ ID NOs: 5, 6, 7 and 8; and
(g) the second polypeptide monomer of the third domain having a polypeptide sequence selected from the group consisting of SEQ ID NOs: 17-24.

Within said aspect, it is also envisaged in the context of the present invention to provide an antibody construct, having an amino acid sequence selected from the group consisting of SEQ ID NOs: 42, 43, 53, 54, 64, 65, 75, 76, 86, 87, 97, 98, 108, 109, 119, 120, 130, 131, 141, 142, 152, 153, 163, 164, 174, 175, 185, 186, 196, 197, 207, 208, 218, 219, 229, 230, 240, 241, 251, 252, 262, 263, 273, 274, 284, 285, 295, 296, 306, 307, 317, 318, 328, 329, 339, 340, 350, 351, 361, 362, 372, 373, 383, 384, 394, 395, 405, 406, 416, 417, 427, 428, 438, 439, 449, 450, 460, 461, 471, 472, 482, 483, 493, 494, 504, 505, 515, 516, 526 and 527.

In a second aspect, it is further envisaged in the context of the present invention to provide a polynucleotide encoding an antibody construct of the present invention.

In a third aspect, it is also envisaged in the context of the present invention to provide a vector comprising a polynucleotide of the present invention.

In a fourth aspect, it is further envisaged in the context of the present invention to provide a host cell transformed or transfected with the polynucleotide or with the vector of the present invention.

In a fifth aspect, it is also envisaged in the context of the present invention to provide a process for the production of an antibody construct of the present invention, said process comprising culturing a host cell of the present invention under conditions allowing the expression of the antibody construct and recovering the produced antibody construct from the culture.

In a sixth aspect, it is further envisaged in the context of the present invention to provide a pharmaceutical composition comprising an antibody construct of the present invention, or produced according to the process of the present invention.

Within said aspect, is also envisaged in the context of the present invention that the pharmaceutical composition is stable for at least four weeks at about −20° C.

It is further envisaged in the context of the present invention to provide the antibody construct of the present invention, or produced according to the process of the present invention, for use in the prevention, treatment or amelioration of a disease selected from a proliferative disease, a tumorous disease, cancer or an immunological disorder.

Within said aspect, it is also envisaged in the context of the present invention that the disease is a gastrointestinal cancer (e.g. gastric cancer, esophageal cancer, gastroesophageal cancer or colorectal cancer) or pancreatic cancer.

Within said aspect, it is also envisaged in the context of the present invention that the disease is a gastric cancer.

In a seventh aspect, it is further envisaged in the context of the present invention to provide a method for the treatment or amelioration of a proliferative disease, a tumorous disease, cancer, or an immunological disorder, comprising the step of administering to a subject in need thereof the antibody construct of the present invention, or produced according to the process of the present invention, wherein the disease preferably is gastrointestinal cancer or pancreatic cancer, most preferably gastric cancer.

In an eighth aspect, it is also envisaged in the context of the present invention to provide a kit comprising an antibody construct of the present invention, or produced according to the process of the present invention, a polynucleotide of the present invention, a vector of the present invention, and/or a host cell of the present invention.

In a ninth aspect, it is further envisaged in the context of the present invention to provide a method for the treatment or amelioration of gastrointestinal cancer, comprising the step of administering to a subject in need thereof a bispecific antibody construct directed against MUC17 and CD3.

In a tenth aspect, it is further envisaged in the context of the present invention to provide bispecific antibody construct directed against MUC17 and CD3 for use in the treatment or amelioration of gastrointestinal cancer.

DESCRIPTION OF THE FIGURES

FIG. 1 shows an epitope clustering of MUC17. Epitopes E1, E2, E3, E4, E5A and 5B as well as truncated versions of E2 (TR2, TR3, TR4 and TR5, respectively) are marked. Experiments on constructs wherein human MUC17 (brown/grey) was replaced by non-functional mouse MUC3 revealed the respective epitopes. 45 MUC17-scFc bispecific antibody constructs were identified which cover the epitope space E2, comprising the SEA domain

FIG. 7: Survey on preferred bispecific antibody constructs according to the present invention with group code (OPTimization library), molecule designation, epitope cluster to which the respective construct binds to, affinity ($K_D$) as per SPR in [nM], cytotoxic activity ($EC_{50}$) in NUGC-4 cells in [pM], the ratio ($EC_{50}/K_D$)*1000 thereof, and the VH VL arrangement.

DETAILED DESCRIPTION

Figure 1:
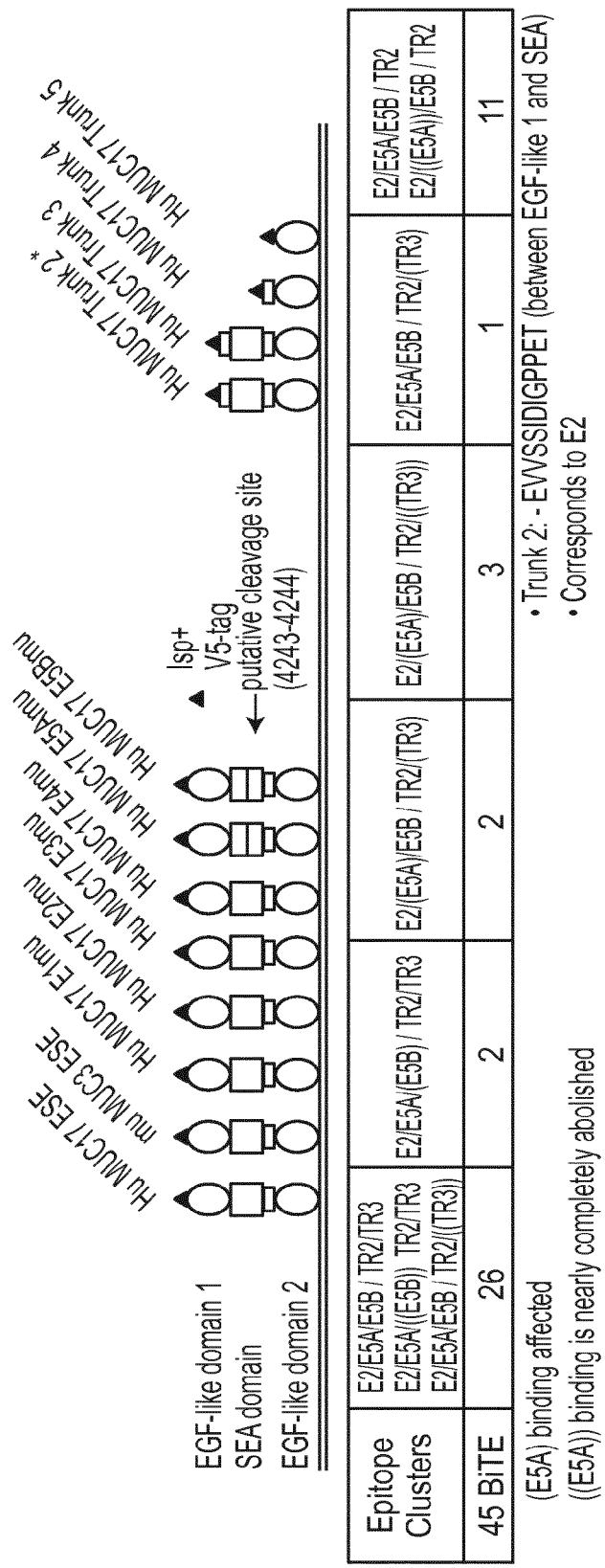
FIG. 1.
Figure 2:
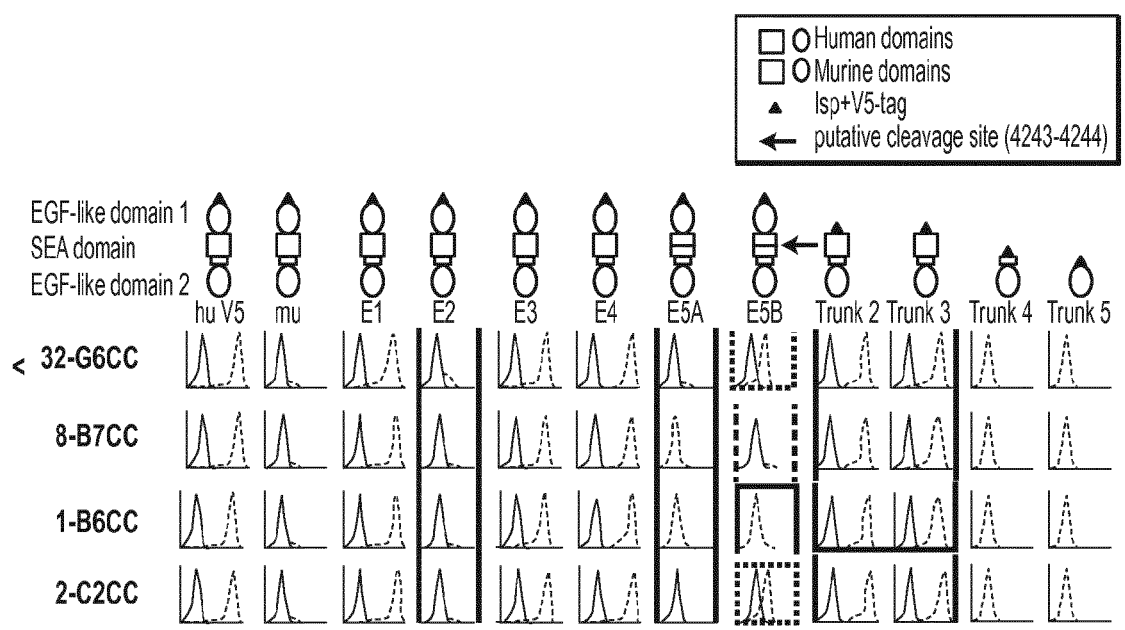
FIG. 2: MUC17 epitope mapping by on-cell binding of the MUC17-scFc bispecific antibody constructs against cells expressing human/mouse chimeric constructs. On-cell binding was assessed by fluorescence-activated cell sorting (FACS), where loss of binding to a chimeric construct indicates the respective (mutated) domain is essential for MUC17-scFc bispecific antibody constructs binding. For example, E2 shows loss of binding upon mutation. Hence, E2 is essential for binding for all four examined bispecific antibody constructs.

In the context of the present invention, a bispecific antibody construct targeting specifically MUC17 associated with a malignancy is provided. To this end, first MUC17 is identified as a gene that is upregulated in gastric tumors relative to normal tissue expression. In this regard, it is shown that the MUC17 protein is expressed in 40-77% of gastric tumors according to immunohistochemistry methods common in the art. It is also demonstrated by flow cytometry that MUC17 protein is expressed on the cell surface of gastric cancer cell lines and esophageal cancer cell lines, in addition to some pancreatic cancer cell lines and colorectal cancer cell lines. It has even been shown that such expression is specifically high in gastric tumors in Chinese patients. Hence, MUC17 is identified as a valid target associated with gastrointestinal cancer, i.e. cancer of the stomach, small intestine and large intestine (colon), esophageal cancer and pancreatic cancer.

It is a surprising finding in the context of the present invention that the bispecific antibody constructs according to the present invention preferably target cancer cells, such as gastric and gastrointestinal cancer cells, bearing MUC17, and in contrast, do less target non-cancer cells. MUC17 is normally expressed on apical surface (i.e. located opposite of the base of the respective cells) of non-cancer intestinal epithelial cells and forms part of mucosal layer. However, MUC 17 is overexpressed in gastric and gastrointestinal cancer and, in such settings, not restricted to apical surface but also expressed on the non-apical surface. Without wanting to be bound by theory, MUC17 on the apical surface is considered to be less accessible to the bispecific antibody constructs according to the present invention while the MUC17 expressed on the non-apical surface in cancer cells is better accessible. Hence, the bispecific antibody constructs according to the present invention preferably target MUC17-associated cancer cells and less non-cancer cells. This has been surprisingly found when comparing good tolerability in healthy animals versus high anti-tumor efficacy in an in vivo caner model. In detail, although immunohistochemistry confirmed MUC17 expression on the apical surface of gastrointestinal tissue such as small intestine sampled from monkeys evaluated in an exploratory toxicology study, advantageously there were no histopathological changes in the tissues expressing MUC17. Good tolerability of non-cancer cells with respect to the bispecific antibody constructs according to the present invention is likewise confirmed in vitro. In contrast, intravenous treatment of tumor-bearing mice with a bispecific antibody construct according to the present invention results in statistically significant and dose-dependent tumor growth inhibition when compared with placebo-treated mice in the control group. Accordingly, the bispecific antibody constructs according to the present invention is preferably tolerated by the patient and features a preferably well manageable therapeutic window which has not been previously described for any MUC17 addressing agent.

Bispecific antibody constructs against the EGF-SEA-EGF region of the MUC17 protein are provided in the context of the present invention. Advantageously, targeting this region of the protein provides selectivity from the nearest family members (MUC3A, MUC3B, MUC12; ee.g., Hollingsworth and Swanson, Nat. Rev. Cancer 2004), and the ability to bind cell-membrane associated MUC17. MUC17, like other transmembrane mucins, contains a potential cleavage site within the SEA domain Accordingly, bispecific antibody constructs that target the MUC17 EGF-SEA-EGF region and CD3 and have a single chain Fc format to extend half-life targeting are herewith envisaged. Advantageously, the bispecific antibody constructs of the present invention preferably have a high affinity for target cells bearing MUC17 target (single digit nM $K_D$) and potency (<50 pM EC50) to allow targeting of low or heterogeneous levels of MUC17 in tumor cells of interest.

It is envisaged that the bispecific antibody constructs according to the present invention have cross-reactivity to, for example, cynomolgus monkey MUC17 (in addition to human MUC17) to enable nonclinical toxicology studies. The significance of the sequence details of the EGF-SEA-EGF domain of cynomolgus monkey MUC17 is presented herein for the first time.

In the context of the present invention, it is envisaged that the bispecific antibody constructs exhibit binding affinity, potent cytotoxic activity, and are the most stable map to the SEA domain In the context of the present invention, it is envisaged that the bispecific antibody constructs have a cysteine clamp, i.e. intramolecular disulfide bond, in the target binder for improved stability.

It is envisaged in the context of the present invention that the bispecific antibody construct provided with a single chain Fc(scFc) as half-life extended (HLE) moiety and directed against MUC17, is intended for use in the treatment of gastrointestinal cancers, including gastric cancer, gastroesophageal cancer, esophageal cancer, pancreatic cancer and colorectal cancer.

Further, it is envisaged as optionally but advantageously in the context of the present invention that the scFc, i.e. HLE, antibody construct enables intravenous dosing that is administered only once every week, once every two weeks, once every three weeks or even once every four weeks, or less frequently.

In the context of the present invention, a preferred epitope to be therapeutically targeted is identified by first eliminating the tandem repeats of MUC17 as they are highly glycosylated and repetitive in sequence. This results in, e.g., a 376 aa undefined region and a 177 aa EGF-like/SEA domain region. Advantageously, targeting the EGF-like/SEA domains allows selectivity from the nearest family members such as MUC3, cross-reactivity with cynomolgus monkey MUC17, and binding to cell membrane-associated MUC17. Subsequently we generated reagents and assays to evaluate binding, and T cell redirected lysis, activation and cytokine release. These assays were used to confirm that the preferred bispecific antibody constructs meet the predefined candidate product profile in terms of affinity, cytotoxic activity and construct stability.

In order to determine the epitope(s) of preferred bispecific antibody constructs directed to MUC17, epitope mapping was conducted as described herein. Preferred bispecific antibody constructs are directed to the epitope E2 comprising the SEA domain. The E2 epitope comprises an amino acid (aa) sequence characterized herein as SEQ ID NO: 528. This essentially corresponds to aa 4171 to 4296 of MUC17 according to uniprot Q685J3 numbering. Generally, MUC17 aa numbering in the context of the present invention is always made or indented to be made in reference to the uniprot Q685J3 numbering of MUC17. On the contrary, bispecific antibody constructs targeting the E1 epitope of MUC17, i.e. an epitope N-terminal to the SEA domain (see FIG. 1), surprisingly show undesired cross-reactivity with MUC3A and MUC3B, which would result in off-target activity and, ultimately, an increased risk of side effects. Further, bispecific antibody constructs directed to epitopes E3 and E4 located C-terminal to the SEA domain (see FIG. 1) unexpectedly do not cross react to cynomolgus monkey MUC17. Hence, it is envisaged that the bispecific antibody constructs according to the present invention specifically and exclusively bind to the E2 epitope of MUC17.

Such preferred bispecific antibody constructs according to the present invention may be further specified based according to their structure or to their unique detailed epitope binding characteristics. Preferred bispecific antibody constructs according to the present invention may be determined by calculating a novel indicative ratio of cytotoxicity to affinity as provided herein. For example, said ratio ($EC_{50}/K_D$)*1000 preferably is <(below) 250. Such a ratio is typically indicative for good binding to truncated variants of epitope E2, i.e. TR2 (trunk2: SEQ ID NO 532) and TR3 (trunk 3: SEQ ID NO: 533), while a ratio >(above) 250 is typically more indicate of good binding to TR2 but not to TR3. In detail, most preferred constructs typically bind to epitope cluster E2/E5A/in part 5B and/or TR2/TR3. They show, e.g., a ($EC_{50}$: $K_D$)*1000 ratio below about 21 and belong to related sequence families (e.g. optimization (OPT) library nomenclature 4a, 4b, 5a and 10. Their VH/VL arrangement is preferably characterized herein as 4 lambda 3 or "413") Such constructs are identified in the context of the present invention, for example, as 8-A7, 8-B7, 8-B8, 8-C7, 8-H8, 8-D7, 4-E7, 8-F9, 1-A6, 8-H9, 1-B6, 8-F11 and 5-H1. Also preferred are constructs which bind to epitope cluster E2/E5A/in part 5B and/or TR2/TR3 and which show a $EC_{50}$: $K_D$ ratio below about 125 and belong to the sequence families (OPT library nomenclature) 1a, 1c and 9. Their VH/VL arrangement is characterized as 3 lambda 3 or "313". Such constructs are identified in the context of the present invention, for example, as 2-D11, 8-E3, 32-G6, 2-C2, 9-C2, 1-B10, 4-B1, 4-F6, 4-G4, 4-A8, 4-B10, 4-H11, and 4-H2. Preferred, but less preferred than the two foregoing sequence families are the binders which bind to epitope cluster E2/in part E5A/in part 5B and/or TR2/in part TR3, and show a $(EC_{50}/K_D)*1000$ ratio below about 1500, typically between 250 and 1450, and belong to the sequence families (OPT library nomenclature) 6, 7 and 8. Their VH/VL arrangement is characterized as 2 kappa 3 or "3k3". Particularly preferred herein are the constructs 32-G6 (SEQ ID NO: 65), 1-B6 (SEQ ID NO: 483), 2-C2 (SEQ ID NO: 428) and 8-B7 (SEQ ID NO: 186). In the context of the present invention, affinity is generally measured by SPC such as BiacoreB analysis and results are typically given in nM. Cytotoxic activity is typically determined using NUGC-4 cells as MUC17 target cells and unstimulated human PBMCs as CD3 effector cells.

It is envisaged in the context of the present invention, that preferred bispecific antibody constructs do not only show a favorable ratio of cytotoxicity to affinity, but additionally show sufficient stability characteristics in order to facilitate practical handling in formulating, storing and administrating said constructs. Sufficient stability is, for example, characterized by a high monomer content (i.e. non-aggregated and/or non-associated, native molecule) after standard preparation, such as at least 65% as determined by preparative size exclusion chromatography (SEC), more preferably at least 70% and even more preferably at least 75%. Also, the turbidity measured, e.g., at 340 nm as optical absorption at a concentration of 2.5 mg/ml should, preferably, be equal to or lower than 0.025, more preferably 0.020, e.g., in order to conclude to the essential absence of undesired aggregates. Advantageously, high monomer content is maintained after incubation in stress conditions such as freeze/thaw or incubation at 37 or 40° C.

Thus, the present invention provides an antibody construct comprising:
a first domain which binds to MUC17,
a second domain which binds to an extracellular epitope of the human and the *Macaca* CD3ε chain; and optionally
a third domain which comprises two polypeptide monomers, each comprising a hinge, a CH2 domain and a CH3 domain, wherein said two polypeptide monomers are fused to each other via a peptide linker.

In an embodiment, the present invention provides a bispecific antibody construct comprising all three such domains.

The term "antibody construct" refers to a molecule in which the structure and/or function is/are based on the structure and/or function of an antibody, e.g., of a full-length or whole immunoglobulin molecule. An antibody construct is hence capable of binding to its specific target or antigen and/or is/are drawn from the variable heavy chain (VH) and/or variable light chain (VL) domains of an antibody or fragment thereof. Furthermore, the domain which binds to its binding partner according to the present invention is understood herein as a binding domain of an antibody construct according to the invention. Typically, a binding domain according to the present invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region), preferably of all six CDRs. An alternative approach to define the minimal structure requirements of an antibody is the definition of the epitope of the antibody within the structure of the specific target, respectively, the protein domain of the target protein composing the epitope region (epitope cluster) or by reference to a specific antibody competing with the epitope of the defined antibody. The antibodies on which the constructs according to the invention are based include for example monoclonal, recombinant, chimeric, deimmunized, humanized and human antibodies.

The binding domain of an antibody construct according to the invention may e.g. comprise the above referred groups of CDRs. Preferably, those CDRs are comprised in the framework of an antibody light chain variable region (VL) and an antibody heavy chain variable region (VH); however, it does not have to comprise both. Fd fragments, for example, have two VH regions and often retain some antigen-binding function of the intact antigen-binding domain. Additional examples for the format of antibody fragments, antibody variants or binding domains include (1) a Fab fragment, a monovalent fragment having the VL, VH, CL and CH1 domains; (2) a F(ab')$_2$ fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFV-library). Examples for embodiments of antibody constructs according to the invention are e.g. described in WO 00/006605, WO 2005/040220, WO 2008/119567, WO 2010/037838, WO 2013/026837, WO 2013/026833, US 2014/0308285, US 2014/0302037, WO 2014/144722, WO 2014/151910, and WO 2015/048272.

Also within the definition of "binding domain" or "domain which binds" are fragments of full-length antibodies, such as VH, VHH, VL, (s)dAb, Fv, Fd, Fab, Fab', F(ab')2 or "r IgG" ("half antibody"). Antibody constructs according to the invention may also comprise modified fragments of antibodies, also called antibody variants, such as scFv, di-scFv or bi(s)-scFv, scFv-Fc, scFv-zipper, scFab, Fab$_2$, Fab$_3$, diabodies, single chain diabodies, tandem diabodies (Tandab's), tandem di-scFv, tandem tri-scFv, "multibodies" such as triabodies or tetrabodies, and single domain antibodies such as nanobodies or single variable domain antibodies comprising merely one variable domain, which may be VHH, VH or VL, that specifically bind an antigen or epitope independently of other V regions or domains.

As used herein, the terms "single-chain Fv," "single-chain antibodies" or "scFv" refer to single polypeptide chain antibody fragments that comprise the variable regions from both the heavy and light chains, but lack the constant regions. Generally, a single-chain antibody further comprises a polypeptide linker between the VH and VL domains which enables it to form the desired structure which would allow for antigen binding. Single chain antibodies are discussed in detail by Pluckthun in The Pharmacology of Monoclonal Antibodies, vol. 113, Rosenburg and Moore eds. Springer-Verlag, New York, pp. 269-315 (1994). Various methods of generating single chain antibodies are known, including those described in U.S. Pat. Nos. 4,694,778 and 5,260,203; International Patent Application Publication No. WO 88/01649; Bird (1988) Science 242:423-442; Huston et al. (1988) Proc. Natl. Acad. Sci. USA 85:5879-5883; Ward et al. (1989) Nature 334:54454; Skerra et al. (1988) Science 242:1038-1041. In specific embodiments, single-chain antibodies can also be bispecific, multispecific, human, and/or humanized and/or synthetic.

Furthermore, the definition of the term "antibody construct" includes monovalent, bivalent and polyvalent/multivalent constructs and, thus, bispecific constructs, specifically binding to only two antigenic structure, as well as polyspecific/multispecific constructs, which specifically bind more than two antigenic structures, e.g. three, four or more, through distinct binding domains. Moreover, the definition of the term "antibody construct" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dübel, Antibody Engineering, Springer, 2nd ed. 2010 and Little, Recombinant Antibodies for Immunotherapy, Cambridge University Press 2009.

The term "bispecific" as used herein refers to an antibody construct which is "at least bispecific", i.e., it comprises at least a first binding domain and a second binding domain, wherein the first binding domain binds to one antigen or target (here: MUC17MUC17), and the second binding domain binds to another antigen or target (here: CD3). Accordingly, antibody constructs according to the invention comprise specificities for at least two different antigens or targets. For example, the first domain does preferably not bind to an extracellular epitope of CD3☐ of one or more of the species as described herein. The term "target cell surface antigen" refers to an antigenic structure expressed by a cell and which is present at the cell surface such that it is accessible for an antibody construct as described herein. It may be a protein, preferably the extracellular portion of a protein, or a carbohydrate structure, preferably a carbohydrate structure of a protein, such as a glycoprotein. It is preferably a tumor antigen. The term "bispecific antibody construct" of the invention also encompasses multispecific antibody constructs such as trispecific antibody constructs, the latter ones including three binding domains, or constructs having more than three (e.g. four, five . . . ) specificities.

Given that the antibody constructs according to the invention are (at least) bispecific, they do not occur naturally and they are markedly different from naturally occurring products. A "bispecific" antibody construct or immunoglobulin is hence an artificial hybrid antibody or immunoglobulin having at least two distinct binding sides with different specificities. Bispecific antibody constructs can be produced by a variety of methods including fusion of hybridomas or linking of Fab' fragments. See, e.g., Songsivilai & Lachmann, Clin. Exp. Immunol. 79:315-321 (1990).

The at least two binding domains and the variable domains (VH/VL) of the antibody construct of the present invention may or may not comprise peptide linkers (spacer peptides). The term "peptide linker" comprises in accordance with the present invention an amino acid sequence by which the amino acid sequences of one (variable and/or binding) domain and another (variable and/or binding) domain of the antibody construct of the invention are linked with each other. The peptide linkers can also be used to fuse the third domain to the other domains of the antibody construct of the invention. An essential technical feature of such peptide linker is that it does not comprise any polymerization activity. Among the suitable peptide linkers are those described in U.S. Pat. Nos. 4,751,180 and 4,935,233 or WO 88/09344. The peptide linkers can also be used to attach other domains or modules or regions (such as half-life extending domains) to the antibody construct of the invention.

The antibody constructs of the present invention are preferably "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. This term thus preferably excludes sequences generated solely by genomic rearrangement in an immune cell in an animal A "recombinant antibody" is an antibody made through the use of recombinant DNA technology or genetic engineering.

The term "monoclonal antibody" (mAb) or monoclonal antibody construct as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic side or determinant on the antigen, in contrast to conventional (polyclonal) antibody preparations which typically include different antibodies directed against different determinants (or epitopes). In addition to their specificity, the monoclonal antibodies are advantageous in that they are synthesized by the hybridoma culture, hence uncontaminated by other immunoglobulins. The modifier "monoclonal" indicates the character of the antibody as being obtained from a substantially homogeneous population of antibodies, and is not to be construed as requiring production of the antibody by any particular method.

For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance analysis, e.g. Biacore™ to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the Biacore system can be used to increase the efficiency of phage antibodies which bind to an epitope of a target cell surface antigen (Schier, Human Antibodies Hybridomas 7 (1996), 97-105; Malmborg, J. Immunol. Methods 183 (1995), 7-13).

Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, Green et al. (1994) Nature Genetics 7:13-21, US 2003-0070185, WO 96/34096, and WO 96/33735.

A monoclonal antibody can also be obtained from a non-human animal, and then modified, e.g., humanized, deimmunized, rendered chimeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dübel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetic diversity can be increased by chain shuffling. Two or three rounds of mutation and selection using display methods like phage display usually results in antibody fragments with affinities in the low nanomolar range.

A preferred type of an amino acid substitutional variation of the antibody constructs involves substituting one or more hypervariable region residues of a parent antibody (e. g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sides (e. g. 6-7 sides) are mutated to generate all possible amino acid substitutions at each side. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sides for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human MUC17. Such contact residues and neighbouring residues are candidates for substitution according to the techniques elaborated herein. Once such variants are generated, the panel of variants is subjected to screening as described herein and antibodies with superior properties in one or more relevant assays may be selected for further development.

The monoclonal antibodies and antibody constructs of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. ScL U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct, antibody fragment or antibody variant may also be modified by specific deletion of human T cell epitopes (a method called "deimmunization") by the methods disclosed for example in WO 98/52976 or WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. MoI. Biol. 227:776-798; Cook, G. P. et al. (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs, variants or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e.g., rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance The humanized antibody may also comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

Humanized antibodies may also be produced using transgenic animals such as mice that express human heavy and light chain genes, but are incapable of expressing the endogenous mouse immunoglobulin heavy and light chain genes. Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982, and EP 239 400).

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or side-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein also contemplates fully human antibodies, which include only non-artificially and/or genetically altered human sequences of antibodies as those can be derived by using technologies or systems such as the Xenomouse. Preferably, a "fully human antibody" does not include amino acid residues not encoded by human germline immunoglobulin sequences.

In some embodiments, the antibody constructs of the invention are "isolated" or "substantially pure" antibody constructs. "Isolated" or "substantially pure", when used to describe the antibody constructs disclosed herein, means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. The antibody constructs may e.g. constitute at least about 5%, or at least about 50% by weight of the total protein in a given sample. It is understood that the isolated protein may constitute from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

The term "binding domain" characterizes in connection with the present invention a domain which (specifically) binds to/interacts with/recognizes a given target epitope or a given target side on the target molecules (antigens), here: MUC17 and CD3, respectively. The structure and function of the first binding domain (recognizing MUC17), and preferably also the structure and/or function of the second binding domain (recognizing CD3), is/are based on the structure and/or function of an antibody, e.g. of a full-length or whole immunoglobulin molecule, and/or is/are drawn from the variable heavy chain (VH) and/or variable light chain (VL) domains of an antibody or fragment thereof. Preferably the first binding domain is characterized by the presence of three light chain CDRs (i.e. CDR1, CDR2 and CDR3 of the VL region) and/or three heavy chain CDRs (i.e. CDR1, CDR2 and CDR3 of the VH region). The second binding domain preferably also comprises the minimum structural requirements of an antibody which allow for the target binding. More preferably, the second binding domain comprises at least three light chain CDRs (i.e. CDR1, CDR2 and CDR3 of the VL region) and/or three heavy chain CDRs (i.e. CDR1, CDR2 and CDR3 of the VH region). It is envisaged that the first and/or second binding domain is produced by or obtainable by phage-display or library screening methods rather than by grafting CDR sequences from a pre-existing (monoclonal) antibody into a scaffold.

According to the present invention, binding domains are in the form of one or more polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids).

The term "polypeptide" as used herein describes a group of molecules, which usually consist of more than 30 amino acids. Polypeptides may further form multimers such as dimers, trimers and higher oligomers, i.e., consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a heteromultimer is an antibody molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is effected e.g. by post-translational modifications like glycosylation, acetylation, phosphorylation and the like. A "peptide", "polypeptide" or "protein" when referred to herein may also be chemically modified such as pegylated. Such modifications are well known in the art and described herein below.

Preferably the binding domain which binds to MUC17 and/or the binding domain which binds to CD3E is/are human binding domains. Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/antibody constructs can be generated through the introduction of human antibody function into a rodent so that the rodent produces fully human antibodies.

The ability to clone and reconstruct megabase-sized human loci in yeast artificial chromosomes YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first Xeno-Mouse mouse strains (see Green et al. Nature Genetics 7:13-21 (1994)). The XenoMouse strains were engineered with YACs containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions may recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620.

The production of the XenoMouseanimals is further discussed and delineated in U.S. patent application Ser. No. 07/466,008, Ser. No. 07/610,515, Ser. No. 07/919,297, Ser. No. 07/922,649, Ser. No. 08/031,801, Ser. No. 08/112,848, Ser. No. 08/234,145, Ser. No. 08/376,279, Ser. No. 08/430,938, Ser. No. 08/464,584, Ser. No. 08/464,582, Ser. No. 08/463,191, Ser. No. 08/462,837, Ser. No. 08/486,853, Ser. No. 08/486,857, Ser. No. 08/486,859, Ser. No. 08/462,513, Ser. No. 08/724,752, and Ser. No. 08/759,620; and U.S. Pat. Nos. 6,162,963; 6,150,584; 6,114,598; 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998), EP 0 463 151 B1, WO 94/02602, WO 96/34096, WO 98/24893, WO 00/76310, and WO 03/47336.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more VH genes, one or more DH genes, one or more JH genes, a mu constant region, and a second constant region (preferably a gamma constant region) are formed into a construct for insertion into an animal. This approach is described in U.S. Pat. No. 5,545, 807 to Surani et al. and U.S. Pat. Nos. 5,545,806; 5,625,825; 5,625,126; 5,633,425; 5,661,016; 5,770,429; 5,789,650; 5,814,318; 5,877,397; 5,874,299; and 6,255,458 each to Lonberg and Kay, U.S. Pat. Nos. 5,591,669 and 6,023.010 to Krimpenfort and Berns, U.S. Pat. Nos. 5,612,205; 5,721, 367; and 5,789,215 to Berns et al., and U.S. Pat. No. 5,643,763 to Choi and Dunn, and GenPharm International U.S. patent application Ser. No. 07/574,748, Ser. No. 07/575,962, Ser. No. 07/810,279, Ser. No. 07/853,408, Ser. No. 07/904,068, Ser. No. 07/990,860, Ser. No. 08/053,131, Ser. No. 08/096,762, Ser. No. 08/155,301, Ser. No. 08/161, 739, Ser. No. 08/165,699, Ser. No. 08/209,741. See also EP 0 546 073 B1, WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175. See further Taylor et al. (1992), Chen et al. (1993), Tuaillon et al. (1993), Choi et al. (1993), Lonberg et al. (1994), Taylor et al. (1994), and Tuaillon et al. (1995), Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a human binding domain against MUC17 and a human binding domain against CD3E in order to vitiate concerns and/or effects of HAMA or HACA response.

The terms "(specifically) binds to", (specifically) recognizes", "is (specifically) directed to", and "(specifically) reacts with" mean in accordance with this invention that a binding domain interacts or specifically interacts with a given epitope or a given target side on the target molecules (antigens), here: MUC17 and CD3ε, respectively.

The term "epitope" refers to a side on an antigen to which a binding domain, such as an antibody or immunoglobulin, or a derivative, fragment or variant of an antibody or an immunoglobulin, specifically binds. An "epitope" is antigenic and thus the term epitope is sometimes also referred to herein as "antigenic structure" or "antigenic determinant". Thus, the binding domain is an "antigen interaction site". Said binding/interaction is also understood to define a "specific recognition".

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically, a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigenic structure for one of the binding domains is comprised within the target cell surface antigen protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

A method for epitope mapping is described in the following: When a region (a contiguous amino acid stretch) in the human MUC17 protein is exchanged or replaced with its corresponding region of a non-human and non-primate MUC17 (e.g., mouse MUC17, but others like chicken, rat, hamster, rabbit etc. may also be conceivable), a decrease in the binding of the binding domain is expected to occur, unless the binding domain is cross-reactive for the non-human, non-primate MUC17 used. Said decrease is preferably at least 10%, 20%, 30%, 40%, or 50%; more preferably at least 60%, 70%, or 80%, and most preferably 90%, 95% or even 100% in comparison to the binding to the respective region in the human MUC17 protein, whereby binding to the respective region in the human MUC17 protein is set to be 100%. It is envisaged that the aforementioned human MUC17/non-human MUC17 chimeras are expressed in CHO cells. It is also envisaged that the human MUC17/non-human MUC17 chimeras are fused with a transmembrane domain and/or cytoplasmic domain of a different membrane-bound protein such as EpCAM.

In an alternative or additional method for epitope mapping, several truncated versions of the human MUC17 extracellular domain can be generated in order to determine a specific region that is recognized by a binding domain. In these truncated versions, the different extracellular MUC17 domains/sub-domains or regions are stepwise deleted, starting from the N-terminus. It is envisaged that the truncated MUC17 versions may be expressed in CHO cells. It is also envisaged that the truncated MUC17 versions may be fused with a transmembrane domain and/or cytoplasmic domain of a different membrane-bound protein such as EpCAM. It is also envisaged that the truncated MUC17 versions may encompass a signal peptide domain at their N-terminus, for example a signal peptide derived from mouse IgG heavy chain signal peptide. It is furthermore envisaged that the truncated MUC17 versions may encompass a v5 domain at their N-terminus (following the signal peptide) which allows verifying their correct expression on the cell surface. A decrease or a loss of binding is expected to occur with those truncated MUC17 versions which do not encompass any more the MUC17 region that is recognized by the binding domain. The decrease of binding is preferably at least 10%, 20%, 30%, 40%, 50%; more preferably at least 60%, 70%, 80%, and most preferably 90%, 95% or even 100%, whereby binding to the entire human MUC17 protein (or its extracellular region or domain) is set to be 100.

A further method to determine the contribution of a specific residue of MUC17 to the recognition by an antibody construct or binding domain is alanine scanning (see e.g. Morrison K L & Weiss G A. Cur Opin Chem Biol. 2001 June; 5(3):302-7), where each residue to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired. Alanine scanning is a mature technology which has been used for a long period of time.

The interaction between the binding domain and the epitope or the region comprising the epitope implies that a binding domain exhibits appreciable affinity for the epitope/the region comprising the epitope on a particular protein or antigen (here: MUC17 and CD3, respectively) and, generally, does not exhibit significant reactivity with proteins or antigens other than the MUC17 or CD3. "Appreciable affinity" includes binding with an affinity of about $10^{-6}$ M ($K_D$) or stronger. Preferably, binding is considered specific when the binding affinity is about $10^{-12}$ to $10^{-8}$ M, $10^{-12}$ to $10^{-9}$ M, $10^{-12}$ to $10^{-10}$ M, $10^{-11}$ to $10^{-8}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than the MUC17 or CD3. Preferably, a binding domain of the invention does not essentially or substantially bind to proteins or antigens other than MUC17 or CD3 (i.e., the first binding domain is not capable of binding to proteins other than MUC17 and the second binding domain is not capable of binding to proteins other than CD3). It is an envisaged characteristic of the antibody constructs according to the present invention to have superior affinity characteristics in comparison to other HLE formats. Such a superior affinity, in consequence, suggests a prolonged half-life in vivo. The longer half-life of the antibody constructs according to the present invention may reduce the duration and frequency of administration which typically contributes to improved patient compliance. This is of particular importance as the antibody constructs of the present invention are particularly beneficial for highly weakened or even multimorbid cancer patients.

The term "does not essentially/substantially bind" or "is not capable of binding" means that a binding domain of the present invention does not bind a protein or antigen other than the MUC17 or CD3, i.e., does not show reactivity of more than 30%, preferably not more than 20%, more preferably not more than 10%, particularly preferably not more than 9%, 8%, 7%, 6% or 5% with proteins or antigens other than MUC17 or CD3, whereby binding to the MUC17 or CD3, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-side with its specific antigen may result in a simple binding of said side to the antigen. Moreover, the specific interaction of the antigen-interaction-side with its specific antigen may alternatively or additionally result in the initiation of a signal, e.g. due to the induction of a change of the conformation of the antigen, an oligomerization of the antigen, etc.

The term "variable" refers to the portions of the antibody or immunoglobulin domains that exhibit variability in their sequence and that are involved in determining the specificity and binding affinity of a particular antibody (i.e., the "variable domain(s)"). The pairing of a variable heavy chain (VH) and a variable light chain (VL) together forms a single antigen-binding site.

Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM or FR) and provide a scaffold for the six CDRs in three dimensional space to form an antigen-binding surface. The variable domains of naturally occurring heavy and light chains each comprise four FRM regions (FR1, FR2, FR3, and FR4), largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding side (see Kabat et al., loc. cit.).

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody with the antigen and hence contribute to the functional activity of an antibody molecule: they are the main determinants of antigen specificity.

The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. MoI. Biol, 1987, 196: 901-917; and MacCallum et al., J. MoI. Biol, 1996, 262: 732). Still another standard for characterizing the antigen binding side is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the so-called Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al. and/or revealed by other techniques, for example, crystallography and two- or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

The CDR3 of the light chain and, particularly, the CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen. Hence, CDR3 is typically the greatest source of molecular diversity within the antibody-binding side. H3, for example, can be as short as two amino acid residues or greater than 26 amino acids.

In a classical full-length antibody or immunoglobulin, each light (L) chain is linked to a heavy (H) chain by one covalent disulfide bond, while the two H chains are linked to each other by one or more disulfide bonds depending on the H chain isotype. The CH domain most proximal to VH is usually designated as CH1. The constant ("C") domains are not directly involved in antigen binding, but exhibit various effector functions, such as antibody-dependent, cell-mediated cytotoxicity and complement activation. The Fc region of an antibody is comprised within the heavy chain constant domains and is for example able to interact with cell surface located Fc receptors.

The sequence of antibody genes after assembly and somatic mutation is highly varied, and these varied genes are estimated to encode $10^{10}$ different antibody molecules (Immunoglobulin Genes, $2^{nd}$ ed., eds. Jonio et al., Academic Press, San Diego, CA, 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

The term "Fc portion" or "Fc monomer" means in connection with this invention a polypeptide comprising at least one domain having the function of a CH2 domain and at least one domain having the function of a CH3 domain of an immunoglobulin molecule. As apparent from the term "Fc monomer", the polypeptide comprising those CH domains is a "polypeptide monomer". An Fc monomer can be a polypeptide comprising at least a fragment of the constant region of an immunoglobulin excluding the first constant region immunoglobulin domain of the heavy chain (CH1), but maintaining at least a functional part of one CH2 domain and a functional part of one CH3 domain, wherein the CH2 domain is amino terminal to the CH3 domain. In a preferred aspect of this definition, an Fc monomer can be a polypeptide constant region comprising a portion of the Ig-Fc hinge region, a CH2 region and a CH3 region, wherein the hinge region is amino terminal to the CH2 domain. It is envisaged that the hinge region of the present invention promotes dimerization. Such Fc polypeptide molecules can be obtained by papain digestion of an immunoglobulin region (of course resulting in a dimer of two Fc polypeptide), for example and not limitation. In another aspect of this definition, an Fc monomer can be a polypeptide region comprising a portion of a CH2 region and a CH3 region. Such Fc polypeptide molecules can be obtained by pepsin digestion of an immunoglobulin molecule, for example and not limitation. In one embodiment, the polypeptide sequence of an Fc monomer is substantially similar to an Fc polypeptide sequence of: an $IgG_1$ Fc region, an $IgG_2$ Fc region, an $IgG_3$ Fc region, an $IgG_4$ Fc region, an IgM Fc region, an IgA Fc region, an IgD Fc region and an IgE Fc region. (See, e.g., Padlan, Molecular Immunology, 31(3), 169-217 (1993)). Because there is some variation between immunoglobulins, and solely for clarity, Fc monomer refers to the last two heavy chain constant region immunoglobulin domains of IgA, IgD, and IgG, and the last three heavy chain constant region immunoglobulin domains of IgE and IgM. As mentioned, the Fc monomer can also include the flexible hinge N-terminal to these domains. For IgA and IgM, the Fc monomer may include the J chain. For IgG, the Fc portion comprises immunoglobulin domains CH2 and CH3 and the hinge between the first two domains and CH2. Although the boundaries of the Fc portion may vary an example for a human IgG heavy chain Fc portion comprising a functional hinge, CH2 and CH3 domain can be defined e.g. to comprise residues D231 (of the hinge domain—corresponding to D234 in Table 1 below) to P476, respectively L476 (for IgG$_4$) of the carboxyl-terminus of the CH3 domain, wherein the numbering is according to Kabat. The two Fc portion or Fc monomer, which are fused to each other via a peptide linker define the third domain of the antibody construct of the invention, which may also be defined as scFc domain In one embodiment of the invention it is envisaged that a scFc domain as disclosed herein, respectively the Fc monomers fused to each other are comprised only in the third domain of the antibody construct.

In line with the present invention an IgG hinge region can be identified by analogy using the Kabat numbering as set forth in Table 1. In line with the above, it is envisaged that for a hinge domain/region of the present invention the minimal requirement comprises the amino acid residues corresponding to the IgG1 sequence stretch of D231 D234 to P243 according to the Kabat numbering. It is likewise envisaged that a hinge domain/region of the present invention comprises or consists of the IgG1 hinge sequence DKTHTCPPCP (SEQ ID NO: 477) (corresponding to the stretch D234 to P243 as shown in Table 1 below—variations of said sequence are also envisaged provided that the hinge region still promotes dimerization). In a preferred embodiment of the invention the glycosylation site at Kabat position 314 of the CH2 domains in the third domain of the antibody construct is removed by a N314X substitution, wherein X is any amino acid excluding Q. Said substitution is preferably a N314G substitution. In a more preferred embodiment, said CH2 domain additionally comprises the following substitutions (position according to Kabat) V321C and R309C (these substitutions introduce the intra domain cysteine disulfide bridge at Kabat positions 309 and 321).

It is also envisaged that the third domain of the antibody construct of the invention comprises or consists in an amino to carboxyl order: DKTHTCPPCP (SEQ ID NO: 477) (i.e. hinge) —CH2-CH3-linker-DKTHTCPPCP (SEQ ID NO: 477) (i.e. hinge) —CH2-CH3. The peptide linker of the aforementioned antibody construct is in a preferred embodiment characterized by the amino acid sequence Gly-Gly-Gly-Gly-Ser, i.e. Gly4Ser (SEQ ID NO: 1), or polymers thereof, i.e. (Gly4Ser)x, where x is an integer of 5 or greater (e.g. 5, 6, 7, 8 etc. or greater), 6 being preferred ((Gly4Ser) 6). Said construct may further comprise the aforementioned substitutions: N314X, preferably N314G, and/or the further substitutions V321C and R309C. In a preferred embodiment of the antibody constructs of the invention as defined herein before, it is envisaged that the second domain binds to an extracellular epitope of the human and/or the *Macaca* CD3ε chain.

TABLE 1

Kabat numbering of the amino acid residues of the hinge region

| IMGT numbering for the hinge | IgG$_1$ amino acid translation | Kabat numbering |
|---|---|---|
| 1 | (E) | 226 |
| 2 | P | 227 |
| 3 | K | 228 |
| 4 | S | 232 |
| 5 | C | 233 |
| 6 | D | 234 |
| 7 | K | 235 |
| 8 | T | 236 |
| 9 | H | 237 |
| 10 | T | 238 |
| 11 | C | 239 |
| 12 | P | 240 |
| 13 | P | 241 |
| 14 | C | 242 |
| 15 | P | 243 |

In further embodiments of the present invention, the hinge domain/region comprises or consists of the IgG2 subtype hinge sequence ERKCCVECPPCP (SEQ ID NO: 478), the IgG3 subtype hinge sequence ELKTPLDTTHTCPRCP (SEQ ID NO: 479) or ELKTPLGDTTHTCPRCP (SEQ ID NO: 486), and/or the IgG4 subtype hinge sequence ESKYGPPCPSCP (SEQ ID NO: 480). The IgG1 subtype hinge sequence may be the following one EPKSCDKTHTCPPCP (as shown in Table 1 and SEQ ID NO: 487). These core hinge regions are thus also envisaged in the context of the present invention.

The location and sequence of the IgG CH2 and IgG CD3 domain can be identified by analogy using the Kabat numbering as set forth in Table 2:

TABLE 2

Kabat numbering of the amino acid residues of the IgG CH2 and CH3 region

| IgG subtype | CH2 aa translation | CH2 Kabat numbering | CH3 aa translation | CH3 Kabat numbering |
|---|---|---|---|---|
| IgG$_1$ | APE . . . KAK | 244 . . . 360 | GQP . . . PGK | 361 . . . 478 |
| IgG$_2$ | APP . . . KTK | 244 . . . 360 | GQP . . . PGK | 361 . . . 478 |
| IgG$_3$ | APE . . . KTK | 244 . . . 360 | GQP . . . PGK | 361 . . . 478 |
| IgG$_4$ | APE . . . KAK | 244 . . . 360 | GQP . . . LGK | 361 . . . 478 |

In one embodiment of the invention the emphasized bold amino acid residues in the CH3 domain of the first or both Fc monomers are deleted.

The peptide linker, by whom the polypeptide monomers ("Fc portion" or "Fc monomer") of the third domain are fused to each other, preferably comprises at least 25 amino acid residues (25, 26, 27, 28, 29, 30 etc.). More preferably, this peptide linker comprises at least 30 amino acid residues (30, 31, 32, 33, 34, 35 etc.). It is also preferred that the linker comprises up to 40 amino acid residues, more preferably up to 35 amino acid residues, most preferably exactly 30 amino acid residues. A preferred embodiment of such peptide linker is characterized by the amino acid sequence Gly-Gly-Gly-Gly-Ser, i.e. Gly$_4$Ser (SEQ ID NO: 1), or polymers thereof, i.e. (Gly$_4$Ser)x, where x is an integer of 5 or greater (e.g. 6, 7 or 8). Preferably the integer is 6 or 7, more preferably the integer is 6.

In the event that a linker is used to fuse the first domain to the second domain, or the first or second domain to the third domain, this linker is preferably of a length and sequence sufficient to ensure that each of the first and second domains can, independently from one another, retain their differential binding specificities. For peptide linkers which connect the at least two binding domains (or two variable domains) in the antibody construct of the invention, those peptide linkers are preferred which comprise only a few number of amino acid residues, e.g. 12 amino acid residues or less. Thus, peptide linkers of 12, 11, 10, 9, 8, 7, 6 or 5 amino acid residues are preferred. An envisaged peptide linker with less than 5 amino acids comprises 4, 3, 2 or one amino acid(s), wherein Gly-rich linkers are preferred. A preferred embodiment of the peptide linker for a fusion the first and the second domain is depicted in SEQ ID NO:1. A preferred linker embodiment of the peptide linker for fusing the second and the third domain is a $(Gly)_4$-linker, also called $G_4$-linker.

A particularly preferred "single" amino acid in the context of one of the above described "peptide linker" is Gly. Accordingly, said peptide linker may consist of the single amino acid Gly. In a preferred embodiment of the invention a peptide linker is characterized by the amino acid sequence Gly-Gly-Gly-Gly-Ser, i.e. $Gly_4Ser$ (SEQ ID NO: 1), or polymers thereof, i.e. $(Gly_4Ser)x$, where x is an integer of 1 or greater (e.g. 2 or 3). Preferred linkers are depicted in SEQ ID NOs: 1 to 12. The characteristics of said peptide linker, which comprise the absence of the promotion of secondary structures, are known in the art and are described e.g. in Dall'Acqua et al. (Biochem. (1998) 37, 9266-9273), Cheadle et al. (Mol Immunol (1992) 29, 21-30) and Raag and Whitlow (FASEB (1995) 9(1), 73-80). Peptide linkers which furthermore do not promote any secondary structures are preferred. The linkage of said domains to each other can be provided, e.g., by genetic engineering, as described in the examples. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, New York, 2001).

In a preferred embodiment of the antibody construct or the present invention the first and second domain form an antibody construct in a format selected from the group consisting of $(scFv)_2$, scFv-single domain mAb, diabody and oligomers of any of these formats.

According to a particularly preferred embodiment, and as documented in the appended examples, the first and the second domain of the antibody construct of the invention is a "bispecific single chain antibody construct", more preferably a bispecific "single chain Fv" (scFv). Although the two domains of the Fv fragment, VL and VH, are coded for by separate genes, they can be joined, using recombinant methods, by a synthetic linker—as described hereinbefore—that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are whole or full-length antibodies. A single-chain variable fragment (scFv) is hence a fusion protein of the variable region of the heavy chain (VH) and of the light chain (VL) of immunoglobulins, usually connected with a short linker peptide of about ten to about 25 amino acids, preferably about 15 to 20 amino acids. The linker is usually rich in glycine for flexibility, as well as serine or threonine for solubility, and can either connect the N-terminus of the VH with the C-terminus of the VL, or vice versa. This protein retains the specificity of the original immunoglobulin, despite removal of the constant regions and introduction of the linker.

Bispecific single chain antibody constructs are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946,778, Kontermann and Dübel (2010), loc. cit. and Little (2009), loc. cit.) can be adapted to produce single chain antibody constructs specifically recognizing (an) elected target(s).

Bivalent (also called divalent) or bispecific single-chain variable fragments (bi-scFvs or di-scFvs having the format $(scFv)_2$ can be engineered by linking two scFv molecules (e.g. with linkers as described hereinbefore). If these two scFv molecules have the same binding specificity, the resulting $(scFv)_2$ molecule will preferably be called bivalent (i.e. it has two valences for the same target epitope). If the two scFv molecules have different binding specificities, the resulting $(scFv)_2$ molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) Proceedings of the National Academy of Sciences of the United States of America 90 (14): 6444-8).

In line with this invention either the first, the second or the first and the second domain may comprise a single domain antibody, respectively the variable domain or at least the CDRs of a single domain antibody. Single domain antibodies comprise merely one (monomeric) antibody variable domain which is able to bind selectively to a specific antigen, independently of other V regions or domains. The first single domain antibodies were engineered from heavy chain antibodies found in camelids, and these are called $V_HH$ fragments. Cartilaginous fishes also have heavy chain antibodies (IgNAR) from which single domain antibodies called $V_{NAR}$ fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies.

A (single domain mAb)$_2$ is hence a monoclonal antibody construct composed of (at least) two single domain monoclonal antibodies, which are individually selected from the group comprising $V_H$, $V_L$, $V_HH$ and $V_{NAR}$. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

Whether or not an antibody construct competes for binding with another given antibody construct can be measured in a competition assay such as a competitive ELISA or a cell-based competition assay. Avidin-coupled microparticles (beads) can also be used similar to an avidin-coated ELISA plate, when reacted with a biotinylated protein, each of these beads can be used as a substrate on which an assay can be performed. Antigen is coated onto a bead and then precoated with the first antibody. The second antibody is added and any additional binding is determined. Possible means for the read-out includes flow cytometry.

T cells or T lymphocytes are a type of lymphocyte (itself a type of white blood cell) that play a central role in cell-mediated immunity. There are several subsets of T cells, each with a distinct function. T cells can be distinguished from other lymphocytes, such as B cells and NK cells, by the presence of a T cell receptor (TCR) on the cell surface. The TCR is responsible for recognizing antigens bound to major histocompatibility complex (MHC) molecules and is composed of two different protein chains. In 95% of the T cells, the TCR consists of an alpha ($\alpha$) and beta ($\beta$) chain. When the TCR engages with antigenic peptide and MHC (peptide/MHC complex), the T lymphocyte is activated through a series of biochemical events mediated by associated enzymes, co-receptors, specialized adaptor molecules, and activated or released transcription factors.

The CD3 receptor complex is a protein complex and is composed of four chains. In mammals, the complex contains a CD3$\gamma$ (gamma) chain, a CD3$\delta$ (delta) chain, and two CD3$\epsilon$ (epsilon) chains. These chains associate with the T cell receptor (TCR) and the so-called (zeta) chain to form the T cell receptor CD3 complex and to generate an activation signal in T lymphocytes. The CD3$\gamma$ (gamma), CD3$\delta$ (delta), and CD3$\epsilon$ (epsilon) chains are highly related cell-surface proteins of the immunoglobulin superfamily containing a single extracellular immunoglobulin domain. The intracellular tails of the CD3 molecules contain a single conserved motif known as an immunoreceptor tyrosine-based activation motif or ITAM for short, which is essential for the signaling capacity of the TCR. The CD3 epsilon molecule is a polypeptide which in humans is encoded by the CD3E gene which resides on chromosome 11. The most preferred epitope of CD3 epsilon is comprised within amino acid residues 1-27 of the human CD3 epsilon extracellular domain. It is envisaged that antibody constructs according to the present invention typically and advantageously show less unspecific T cell activation, which is not desired in specific immunotherapy. This translates to a reduced risk of side effects.

The redirected lysis of target cells via the recruitment of T cells by a multispecific, at least bispecific, antibody construct involves cytolytic synapse formation and delivery of perforin and granzymes. The engaged T cells are capable of serial target cell lysis, and are not affected by immune escape mechanisms interfering with peptide antigen processing and presentation, or clonal T cell differentiation; see, for example, WO 2007/042261.

Cytotoxicity mediated by antibody constructs of the invention can be measured in various ways. Effector cells can be e.g. stimulated enriched (human) CD8 positive T cells or unstimulated (human) peripheral blood mononuclear cells (PBMC). If the target cells are of macaque origin or express or are transfected with macaque MUC17 which is bound by the first domain, the effector cells should also be of macaque origin such as a macaque T cell line, e.g. 4119LnPx. The target cells should express (at least the extracellular domain of) MUC17, e.g. human or macaque MUC17. Target cells can be a cell line (such as CHO) which is stably or transiently transfected with MUC17, e.g. human or macaque MUC17. Usually $EC_{50}$ values are expected to be lower with target cell lines expressing higher levels of MUC17 on the cell surface. The effector to target cell (E:T) ratio is usually about 10:1, but can also vary. Cytotoxic activity of MUC17bispecific antibody constructs can be measured in a $^{51}$Cr-release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by MUC17×CD3 bispecific antibody constructs of the present invention is preferably measured in a cell-based cytotoxicity assay. It may also be measured in a $^{51}$Cr-release assay. It is represented by the $EC_{50}$ value, which corresponds to the half maximal effective concentration (concentration of the antibody construct which induces a cytotoxic response halfway between the baseline and maximum). Preferably, the $EC_{50}$ value of the MUC17×CD3 bispecific antibody constructs is ≤5000 pM or ≤4000 pM, more preferably ≤3000 pM or ≤2000 pM, even more preferably ≤1000 pM or ≤500 pM, even more preferably ≤400 pM or ≤300 pM, even more preferably ≤200 pM, even more preferably ≤100 pM, even more preferably ≤50 pM, even more preferably ≤20 pM or ≤10 pM, and most preferably ≤5 pM.

The above given $EC_{50}$ values can be measured in different assays. The skilled person is aware that an $EC_{50}$ value can be expected to be lower when stimulated/enriched CD8$^+$ T cells are used as effector cells, compared with unstimulated PBMC. It can furthermore be expected that the $EC_{50}$ values are lower when the target cells express a high number of MUC17 compared with a low target expression rat. For example, when stimulated/enriched human CD8$^+$ T cells are used as effector cells (and either MUC17 transfected cells such as CHO cells or MUC17 positive human cell lines are used as target cells), the $EC_{50}$ value of the MUC17×CD3 bispecific antibody construct is preferably ≤1000 pM, more preferably ≤500 pM, even more preferably ≤250 pM, even more preferably ≤100 pM, even more preferably ≤50 pM, even more preferably ≤10 pM, and most preferably ≤5 pM. When human PBMCs are used as effector cells, the $EC_{50}$ value of the MUC17×CD3 bispecific antibody construct is preferably ≤5000 pM or ≤4000 pM (in particular when the target cells are MUC17 positive human cell lines), more preferably ≤2000 pM (in particular when the target cells are MUC17 transfected cells such as CHO cells), more preferably ≤1000 pM or ≤500 pM, even more preferably ≤200 pM, even more preferably ≤150 pM, even more preferably ≤100 pM, and most preferably ≤50 pM, or lower. When a macaque T cell line such as LnPx4119 is used as effector cells, and a macaque MUC17 transfected cell line such as CHO cells is used as target cell line, the $EC_{50}$ value of the MUC17×CD3 bispecific antibody construct is preferably ≤2000 pM or ≤1500 pM, more preferably ≤1000 pM or ≤500 pM, even more preferably ≤300 pM or ≤250 pM, even more preferably ≤100 pM, and most preferably ≤50 pM.

Preferably, the MUC17×CD3 bispecific antibody constructs of the present invention do not induce/mediate lysis or do not essentially induce/mediate lysis of MUC17 negative cells such as CHO cells. The term "do not induce lysis", "do not essentially induce lysis", "do not mediate lysis" or "do not essentially mediate lysis" means that an antibody construct of the present invention does not induce or mediate lysis of more than 30%, preferably not more than 20%, more preferably not more than 10%, particularly preferably not more than 9%, 8%, 7%, 6% or 5% of MUC17 negative cells, whereby lysis of a MUC17 positive human cell line is set to be 100%. This usually applies for concentrations of the antibody construct of up to 500 nM. The skilled person knows how to measure cell lysis without further ado. Moreover, the present specification teaches specific instructions how to measure cell lysis.

The difference in cytotoxic activity between the monomeric and the dimeric isoform of individual MUC17×CD3 bispecific antibody constructs is referred to as "potency gap". This potency gap can e.g. be calculated as ratio between $EC_{50}$ values of the molecule's monomeric and dimeric form. Potency gaps of the MUC17×CD3 bispecific antibody constructs of the present invention are preferably ≤5, more preferably ≤4, even more preferably ≤3, even more preferably ≤2 and most preferably ≤1.

The first and/or the second (or any further) binding domain(s) of the antibody construct of the invention is/are preferably cross-species specific for members of the mammalian order of primates. Cross-species specific CD3 binding domains are, for example, described in WO 2008/119567. According to one embodiment, the first and/or second binding domain, in addition to binding to human MUC17 and human CD3, respectively, will also bind to MUC17/CD3 of primates including (but not limited to) new world primates (such as *Callithrix jacchus, Saguinus Oedipus* or *Saimiri sciureus*), old world primates (such baboons and macaques), gibbons, and non-human homininae.

In one embodiment of the antibody construct of the invention the first domain binds to human MUC17 and further binds to macaque MUC17, such as MUC17 of *Macaca fascicularis*, and more preferably, to macaque MUC17 expressed on the surface of cells, e.g. such as CHO or 293 cells. The affinity of the first domain for MUC17, preferably for human MUC17, is preferably ≤100 nM or ≤50 nM, more preferably ≤25 nM or ≤20 nM, more preferably ≤15 nM or ≤10 nM, even more preferably ≤5 nM, even more preferably ≤2.5 nM or ≤2 nM, even more preferably ≤1 nM, even more preferably ≤0.6 nM, even more preferably ≤0.5 nM, and most preferably ≤0.4 nM. The affinity can be measured for example in a BIAcore assay or in a Scatchard assay. Other methods of determining the affinity are also well-known to the skilled person. The affinity of the first domain for macaque MUC17 is preferably ≤15 nM, more preferably ≤10 nM, even more preferably ≤5 nM, even more preferably ≤1 nM, even more preferably ≤0.5 nM, even more preferably ≤0.1 nM, and most preferably ≤0.05 nM or even ≤0.01 nM.

Preferably the affinity gap of the antibody constructs according to the invention for binding macaque MUC17 versus human MUC17 [ma MUC17: hu MUC17] (as determined e.g. by BiaCore or by Scatchard analysis) is <100, preferably <20, more preferably <15, further preferably <10, even more preferably <8, more preferably <6 and most preferably <2. Preferred ranges for the affinity gap of the antibody constructs according to the invention for binding macaque MUC17 versus human MUC17 are between 0.1 and 20, more preferably between 0.2 and 10, even more preferably between 0.3 and 6, even more preferably between 0.5 and 3 or between 0.5 and 2.5, and most preferably between 0.5 and 2 or between 0.6 and 2.

The second domain of the antibody construct of the invention binds to human CD3 epsilon and/or to *Macaca* CD3 epsilon. In a preferred embodiment the second domain further binds to *Callithrix jacchus, Saguinus Oedipus* or *Saimiri sciureus* CD3 epsilon. *Callithrix jacchus* and *Saguinus oedipus* are both new world primate belonging to the family of Callitrichidae, while *Saimiri sciureus* is a new world primate belonging to the family of Cebidae.

It is preferred for the antibody construct of the present invention that the second domain which binds to an extracellular epitope of the human and/or the *Macaca* CD3 epsilon chain comprises a VL region comprising CDR-L1, CDR-L2 and CDR-L3 selected from:
  (a) CDR-L1 as depicted in SEQ ID NO: 27 of WO 2008/119567 (SEQ ID NO: 557 herein), CDR-L2 as depicted in SEQ ID NO: 28 of WO 2008/119567 (SEQ ID NO: 542 herein) and CDR-L3 as depicted in SEQ ID NO: 29 of WO 2008/119567 (SEQ ID NO: 546 herein);
  (b) CDR-L1 as depicted in SEQ ID NO: 117 of WO 2008/119567 (SEQ ID NO: 574 herein), CDR-L2 as depicted in SEQ ID NO: 118 of WO 2008/119567 (SEQ ID NO: 572 herein) and CDR-L3 as depicted in SEQ ID NO: 119 of WO 2008/119567 (SEQ ID NO: 546 herein); and
  (c) CDR-L1 as depicted in SEQ ID NO: 153 of WO 2008/119567 (SEQ ID NO: 581 herein), CDR-L2 as depicted in SEQ ID NO: 154 of WO 2008/119567 (SEQ ID NO: 542 herein) and CDR-L3 as depicted in SEQ ID NO: 155 of WO 2008/119567 (SEQ ID NO: 582 herein).

In a furthermore preferred embodiment of the antibody construct of the present invention, the second domain which binds to an extracellular epitope of the human and/or the *Macaca* CD3 epsilon chain comprises a VH region comprising CDR-H 1, CDR-H2 and CDR-H3 selected from:
  (a) CDR-H1 as depicted in SEQ ID NO: 12 of WO 2008/119567 (SEQ ID NO: 553 herein), CDR-H2 as depicted in SEQ ID NO: 13 of WO 2008/119567 (SEQ ID NO: 540 herein) and CDR-H3 as depicted in SEQ ID NO: 14 of WO 2008/119567 (SEQ ID NO: 554 herein);
  (b) CDR-H1 as depicted in SEQ ID NO: 30 of WO 2008/119567 (SEQ ID NO: 538 herein), CDR-H2 as depicted in SEQ ID NO: 31 of WO 2008/119567 (SEQ ID NO: 541 herein) and CDR-H3 as depicted in SEQ ID NO: 32 of WO 2008/119567 (SEQ ID NO: 543 herein);
  (c) CDR-H1 as depicted in SEQ ID NO: 48 of WO 2008/119567 (SEQ ID NO: 547 herein), CDR-H2 as depicted in SEQ ID NO: 49 of WO 2008/119567 (SEQ ID NO: 539 herein) and CDR-H3 as depicted in SEQ ID NO: 50 of WO 2008/119567 (SEQ ID NO: 558 herein);
  (d) CDR-H1 as depicted in SEQ ID NO: 66 of WO 2008/119567 (SEQ ID NO: 561 herein), CDR-H2 as depicted in SEQ ID NO: 67 of WO 2008/119567 (SEQ ID NO: 539 herein) and CDR-H3 as depicted in SEQ ID NO: 68 of WO 2008/119567 (SEQ ID NO: 562 herein);
  (e) CDR-H1 as depicted in SEQ ID NO: 84 of WO 2008/119567 (SEQ ID NO: 548 herein), CDR-H2 as depicted in SEQ ID NO: 85 of WO 2008/119567 (SEQ ID NO: 549 herein) and CDR-H3 as depicted in SEQ ID NO: 86 of WO 2008/119567 (SEQ ID NO: 565 herein);
  (f) CDR-H1 as depicted in SEQ ID NO: 102 of WO 2008/119567 (SEQ ID NO: 538 herein), CDR-H2 as depicted in SEQ ID NO: 103 of WO 2008/119567 (SEQ ID NO: 540 herein) and CDR-H3 as depicted in SEQ ID NO: 104 of WO 2008/119567 (SEQ ID NO: 568 herein);
  (g) CDR-H1 as depicted in SEQ ID NO: 120 of WO 2008/119567 (SEQ ID NO: 573 herein), CDR-H2 as depicted in SEQ ID NO: 121 of WO 2008/119567

(SEQ ID NO: 574 herein) and CDR-H3 as depicted in SEQ ID NO: 122 of WO 2008/119567 (SEQ ID NO: 575 herein);

(h) CDR-H1 as depicted in SEQ ID NO: 138 of WO 2008/119567 (SEQ ID NO: 548 herein), CDR-H2 as depicted in SEQ ID NO: 139 of WO 2008/119567 (SEQ ID NO: 549 herein) and CDR-H3 as depicted in SEQ ID NO: 140 of WO 2008/119567 (SEQ ID NO: 578 herein);

(i) CDR-H1 as depicted in SEQ ID NO: 156 of WO 2008/119567 (SEQ ID NO: 547 herein), CDR-H2 as depicted in SEQ ID NO: 157 of WO 2008/119567 (SEQ ID NO: 539 herein) and CDR-H3 as depicted in SEQ ID NO: 158 of WO 2008/119567 (SEQ ID NO: 583 herein); and (j) CDR-H1 as depicted in SEQ ID NO: 174 of WO 2008/119567 (SEQ ID NO: 538 herein), CDR-H2 as depicted in SEQ ID NO: 175 of WO 2008/119567 (SEQ ID NO: 541 herein) and CDR-H3 as depicted in SEQ ID NO: 176 of WO 2008/119567 (SEQ ID NO: 543 herein).

In a preferred embodiment of the antibody construct of the invention the above described three groups of VL CDRs are combined with the above described ten groups of VH CDRs within the second binding domain to form (30) groups, each comprising CDR-L 1-3 and CDR-H 1-3.

It is preferred for the antibody construct of the present invention that the second domain which binds to CD3 comprises a VL region selected from the group consisting of those depicted in SEQ ID NOs: 17, 21, 35, 39, 53, 57, 71, 75, 89, 93, 107, 111, 125, 129, 143, 147, 161, 165, 179 or 183 of WO 2008/119567 (SEQ ID NOs: 537, 536, 537, 536, 537, 536, 537, 536, 550, 551, 537, 536, 550, 551, 537, 536, 13, 552, 13, or 552 herein) or as depicted in SEQ ID NO: 13 according to the present invention.

It is also preferred that the second domain which binds to CD3 comprises a VH region selected from the group consisting of those depicted in SEQ ID NO: 15, 19, 33, 37, 51, 55, 69, 73, 87, 91, 105, 109, 123, 127, 141, 145, 159, 163, 177 or 181 of WO 2008/119567 (SEQ ID NOs: 555, 556, 544, 545, 559, 560, 563, 564, 566, 567, 569, 570, 576, 577, 579, 580, 584, 585, 544, or 545 herein) or as depicted in SEQ ID NO: 14.

More preferably, the antibody construct of the present invention is characterized by a second domain which binds to CD3 comprising a VL region and a VH region selected from the group consisting of:

(a) a VL region as depicted in SEQ ID NO: 17 or 21 of WO 2008/119567 (SEQ ID NOs: 537 and 536 herein) and a VH region as depicted in SEQ ID NO: 15 or 19 of WO 2008/119567 (SEQ ID NOs: 555 and 556 herein);

(b) a VL region as depicted in SEQ ID NO: 35 or 39 of WO 2008/119567 (SEQ ID NOs: 537 and 536 herein) and a VH region as depicted in SEQ ID NO: 33 or 37 of WO 2008/119567 (SEQ ID NOs: 544 and 545 herein);

(c) a VL region as depicted in SEQ ID NO: 53 or 57 of WO 2008/119567 (SEQ ID NOs: 537 and 536 herein) and a VH region as depicted in SEQ ID NO: 51 or 55 of WO 2008/119567 (SEQ ID NOs: 559 and 560 herein);

(d) a VL region as depicted in SEQ ID NO: 71 or 75 of WO 2008/119567 (SEQ ID NOs: 537 and 536 herein) and a VH region as depicted in SEQ ID NO: 69 or 73 of WO 2008/119567 (SEQ ID NOs: 563 and 564 herein);

(e) a VL region as depicted in SEQ ID NO: 89 or 93 of WO 2008/119567 (SEQ ID NOs: 550 and 551 herein) and a VH region as depicted in SEQ ID NO: 87 or 91 of WO 2008/119567 (SEQ ID NOs: 566 and 567 herein);

(f) a VL region as depicted in SEQ ID NO: 107 or 111 of WO 2008/119567 (SEQ ID NOs: 537 and 536 herein) and a VH region as depicted in SEQ ID NO: 105 or 109 of WO 2008/119567 (SEQ ID NOs: 569 and 570 herein);

(g) a VL region as depicted in SEQ ID NO: 125 or 129 of WO 2008/119567 (SEQ ID NOs: 550 and 551 herein) and a VH region as depicted in SEQ ID NO: 123 or 127 of WO 2008/119567 (SEQ ID NOs: 576 and 577 herein);

(h) a VL region as depicted in SEQ ID NO: 143 or 147 of WO 2008/119567 (SEQ ID NOs: 537 and 536 herein) and a VH region as depicted in SEQ ID NO: 141 or 145 of WO 2008/119567 (SEQ ID NOs: 579 and 580 herein);

(i) a VL region as depicted in SEQ ID NO: 161 or 165 of WO 2008/119567 (SEQ ID NOs: 13 and 552 herein) and a VH region as depicted in SEQ ID NO: 159 or 163 of WO 2008/119567 (SEQ ID NOs: 584 and 585 herein); and (j) a VL region as depicted in SEQ ID NO: 179 or 183 of WO 2008/119567 (SEQ ID NOs: 13 and 552 herein) and a VH region as depicted in SEQ ID NO: 177 or 181 of WO 2008/119567 (SEQ ID NOs: 544 and 545 herein).

Also preferred in connection with the antibody construct of the present invention is a second domain which binds to CD3 comprising a VL region as depicted in SEQ ID NO: 13 and a VH region as depicted in SEQ ID NO: 14.

According to a preferred embodiment of the antibody construct of the present invention, the first and/or the second domain have the following format: The pairs of VH regions and VL regions are in the format of a single chain antibody (scFv). The VH and VL regions are arranged in the order VH-VL or VL-VH. It is preferred that the VH-region is positioned N-terminally of a linker sequence, and the VL-region is positioned C-terminally of the linker sequence.

A preferred embodiment of the above described antibody construct of the present invention is characterized by the second domain which binds to CD3 comprising an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567 (SEQ ID NOs: 586-605 herein) or as depicted in SEQ ID NO: 15.

It is also envisaged that the first binding domain of the antibody construct of the invention comprises a VL region comprising CDR-L1, CDR-L2 and CDR-L3, and a VH region comprising CDR-H1, CDR-H2 and CDR-3 selected from the group consisting of:

(a) CDR-L1 as depicted in SEQ ID NO. 36, CDR-L2 as depicted in SEQ ID NO. 37 and CDR-L3 as depicted in SEQ ID NO. 38 and CDR-H1 as depicted in SEQ ID NO. 33, CDR-H2 as depicted in SEQ ID NO. 34 and CDR-H3 as depicted in SEQ ID NO. 35;

(b) CDR-L1 as depicted in SEQ ID NO. 47, CDR-L2 as depicted in SEQ ID NO. 48 and CDR-L3 as depicted in SEQ ID NO. 49 and CDR-H1 as depicted in SEQ ID NO. 44, CDR-H2 as depicted in SEQ ID NO. 45 and CDR-H3 as depicted in SEQ ID NO. 46;

(c) CDR-L1 as depicted in SEQ ID NO. 58, CDR-L2 as depicted in SEQ ID NO. 59 and CDR-L3 as depicted in SEQ ID NO. 60 and CDR-H1 as depicted in SEQ ID NO. 55, CDR-H2 as depicted in SEQ ID NO. 56 and CDR-H3 as depicted in SEQ ID NO. 57;

(d) CDR-L1 as depicted in SEQ ID NO. 69, CDR-L2 as depicted in SEQ ID NO. 70 and CDR-L3 as depicted in SEQ ID NO. 71 and CDR-H1 as depicted in SEQ ID NO. 66, CDR-H2 as depicted in SEQ ID NO. 67 and CDR-H3 as depicted in SEQ ID NO. 68;

(e) CDR-L1 as depicted in SEQ ID NO. 80, CDR-L2 as depicted in SEQ ID NO. 81 and CDR-L3 as depicted in SEQ ID NO. 82 and CDR-H1 as depicted in SEQ ID NO. 77, CDR-H2 as depicted in SEQ ID NO. 78 and CDR-H3 as depicted in SEQ ID NO. 79;

(f) CDR-L1 as depicted in SEQ ID NO. 91, CDR-L2 as depicted in SEQ ID NO. 92 and CDR-L3 as depicted in SEQ ID NO. 93 and CDR-H1 as depicted in SEQ ID NO. 88, CDR-H2 as depicted in SEQ ID NO. 89 and CDR-H3 as depicted in SEQ ID NO. 90;

(g) CDR-L1 as depicted in SEQ ID NO. 102, CDR-L2 as depicted in SEQ ID NO. 103 and CDR-L3 as depicted in SEQ ID NO. 104 and CDR-H1 as depicted in SEQ ID NO. 99, CDR-H2 as depicted in SEQ ID NO. 100 and CDR-H3 as depicted in SEQ ID NO. 101;

(h) CDR-L1 as depicted in SEQ ID NO. 113, CDR-L2 as depicted in SEQ ID NO. 114 and CDR-L3 as depicted in SEQ ID NO. 115 and CDR-H1 as depicted in SEQ ID NO. 110, CDR-H2 as depicted in SEQ ID NO. 111 and CDR-H3 as depicted in SEQ ID NO. 112;

(i) CDR-L1 as depicted in SEQ ID NO. 124, CDR-L2 as depicted in SEQ ID NO. 125 and CDR-L3 as depicted in SEQ ID NO. 126 and CDR-H1 as depicted in SEQ ID NO. 121, CDR-H2 as depicted in SEQ ID NO. 122 and CDR-H3 as depicted in SEQ ID NO. 123;

(j) CDR-L1 as depicted in SEQ ID NO. 135, CDR-L2 as depicted in SEQ ID NO. 136 and CDR-L3 as depicted in SEQ ID NO. 137 and CDR-H1 as depicted in SEQ ID NO. 132, CDR-H2 as depicted in SEQ ID NO. 133 and CDR-H3 as depicted in SEQ ID NO. 134;

(k) CDR-L1 as depicted in SEQ ID NO. 146, CDR-L2 as depicted in SEQ ID NO. 147 and CDR-L3 as depicted in SEQ ID NO. 148 and CDR-H1 as depicted in SEQ ID NO. 143, CDR-H2 as depicted in SEQ ID NO. 144 and CDR-H3 as depicted in SEQ ID NO. 145;

(l) CDR-L1 as depicted in SEQ ID NO. 157, CDR-L2 as depicted in SEQ ID NO. 158 and CDR-L3 as depicted in SEQ ID NO. 159 and CDR-H1 as depicted in SEQ ID NO. 154, CDR-H2 as depicted in SEQ ID NO. 155 and CDR-H3 as depicted in SEQ ID NO. 156;

(m) CDR-L1 as depicted in SEQ ID NO. 168, CDR-L2 as depicted in SEQ ID NO. 169 and CDR-L3 as depicted in SEQ ID NO. 170 and CDR-H1 as depicted in SEQ ID NO. 165, CDR-H2 as depicted in SEQ ID NO. 166 and CDR-H3 as depicted in SEQ ID NO. 167;

(n) CDR-L1 as depicted in SEQ ID NO. 179, CDR-L2 as depicted in SEQ ID NO. 180 and CDR-L3 as depicted in SEQ ID NO. 181 and CDR-H1 as depicted in SEQ ID NO. 176, CDR-H2 as depicted in SEQ ID NO. 177 and CDR-H3 as depicted in SEQ ID NO. 178;

(o) CDR-L1 as depicted in SEQ ID NO. 190, CDR-L2 as depicted in SEQ ID NO. 191 and CDR-L3 as depicted in SEQ ID NO. 192 and CDR-H1 as depicted in SEQ ID NO. 187, CDR-H2 as depicted in SEQ ID NO. 188 and CDR-H3 as depicted in SEQ ID NO. 189;

(p) CDR-L1 as depicted in SEQ ID NO. 201, CDR-L2 as depicted in SEQ ID NO. 202 and CDR-L3 as depicted in SEQ ID NO. 203 and CDR-H1 as depicted in SEQ ID NO. 198, CDR-H2 as depicted in SEQ ID NO. 199 and CDR-H3 as depicted in SEQ ID NO. 200;

(q) CDR-L1 as depicted in SEQ ID NO. 212, CDR-L2 as depicted in SEQ ID NO. 213 and CDR-L3 as depicted in SEQ ID NO. 214 and CDR-H1 as depicted in SEQ ID NO. 209, CDR-H2 as depicted in SEQ ID NO. 210 and CDR-H3 as depicted in SEQ ID NO. 211;

(r) CDR-L1 as depicted in SEQ ID NO. 223, CDR-L2 as depicted in SEQ ID NO. 224 and CDR-L3 as depicted in SEQ ID NO. 225 and CDR-H1 as depicted in SEQ ID NO. 220, CDR-H2 as depicted in SEQ ID NO. 221 and CDR-H3 as depicted in SEQ ID NO. 222;

(s) CDR-L1 as depicted in SEQ ID NO. 234, CDR-L2 as depicted in SEQ ID NO. 235 and CDR-L3 as depicted in SEQ ID NO. 236 and CDR-H1 as depicted in SEQ ID NO. 231, CDR-H2 as depicted in SEQ ID NO. 232 and CDR-H3 as depicted in SEQ ID NO. 233;

(t) CDR-L1 as depicted in SEQ ID NO. 245, CDR-L2 as depicted in SEQ ID NO. 246 and CDR-L3 as depicted in SEQ ID NO. 247 and CDR-H1 as depicted in SEQ ID NO. 242, CDR-H2 as depicted in SEQ ID NO. 243 and CDR-H3 as depicted in SEQ ID NO. 244;

(u) CDR-L1 as depicted in SEQ ID NO. 256, CDR-L2 as depicted in SEQ ID NO. 257 and CDR-L3 as depicted in SEQ ID NO. 258 and CDR-H1 as depicted in SEQ ID NO. 253, CDR-H2 as depicted in SEQ ID NO. 254 and CDR-H3 as depicted in SEQ ID NO. 255;

(v) CDR-L1 as depicted in SEQ ID NO. 267, CDR-L2 as depicted in SEQ ID NO. 268 and CDR-L3 as depicted in SEQ ID NO. 269 and CDR-H1 as depicted in SEQ ID NO. 264, CDR-H2 as depicted in SEQ ID NO. 265 and CDR-H3 as depicted in SEQ ID NO. 266;

(w) CDR-L1 as depicted in SEQ ID NO. 278, CDR-L2 as depicted in SEQ ID NO. 279 and CDR-L3 as depicted in SEQ ID NO. 280 and CDR-H1 as depicted in SEQ ID NO. 275, CDR-H2 as depicted in SEQ ID NO. 276 and CDR-H3 as depicted in SEQ ID NO. 276;

(x) CDR-L1 as depicted in SEQ ID NO. 289, CDR-L2 as depicted in SEQ ID NO. 290 and CDR-L3 as depicted in SEQ ID NO. 291 and CDR-H1 as depicted in SEQ ID NO. 286, CDR-H2 as depicted in SEQ ID NO. 287 and CDR-H3 as depicted in SEQ ID NO. 288;

(y) CDR-L1 as depicted in SEQ ID NO. 300, CDR-L2 as depicted in SEQ ID NO. 301 and CDR-L3 as depicted in SEQ ID NO. 302 and CDR-H1 as depicted in SEQ ID NO. 297, CDR-H2 as depicted in SEQ ID NO. 298 and CDR-H3 as depicted in SEQ ID NO. 299;

(z) CDR-L1 as depicted in SEQ ID NO. 311, CDR-L2 as depicted in SEQ ID NO. 312 and CDR-L3 as depicted in SEQ ID NO. 313 and CDR-H1 as depicted in SEQ ID NO. 308, CDR-H2 as depicted in SEQ ID NO. 309 and CDR-H3 as depicted in SEQ ID NO. 310;

(aa) CDR-L1 as depicted in SEQ ID NO. 322, CDR-L2 as depicted in SEQ ID NO. 323 and CDR-L3 as depicted in SEQ ID NO. 324 and CDR-H1 as depicted in SEQ ID NO. 319, CDR-H2 as depicted in SEQ ID NO. 320 and CDR-H3 as depicted in SEQ ID NO. 321;

(ab) CDR-L1 as depicted in SEQ ID NO. 333, CDR-L2 as depicted in SEQ ID NO. 334 and CDR-L3 as depicted in SEQ ID NO. 335 and CDR-H1 as depicted in SEQ ID NO. 330, CDR-H2 as depicted in SEQ ID NO. 331 and CDR-H3 as depicted in SEQ ID NO. 332;

(ac) CDR-L1 as depicted in SEQ ID NO. 344, CDR-L2 as depicted in SEQ ID NO. 345 and CDR-L3 as depicted in SEQ ID NO. 346 and CDR-H1 as depicted in SEQ ID NO. 341, CDR-H2 as depicted in SEQ ID NO. 342 and CDR-H3 as depicted in SEQ ID NO. 343;

(ad) CDR-L1 as depicted in SEQ ID NO. 355, CDR-L2 as depicted in SEQ ID NO. 356 and CDR-L3 as depicted in SEQ ID NO. 357 and CDR-H1 as depicted in SEQ ID NO. 352, CDR-H2 as depicted in SEQ ID NO. 353 and CDR-H3 as depicted in SEQ ID NO. 354;
(ae) CDR-L1 as depicted in SEQ ID NO. 366, CDR-L2 as depicted in SEQ ID NO. 367 and CDR-L3 as depicted in SEQ ID NO. 368 and CDR-H1 as depicted in SEQ ID NO. 363, CDR-H2 as depicted in SEQ ID NO. 364 and CDR-H3 as depicted in SEQ ID NO. 365;
(af) CDR-L1 as depicted in SEQ ID NO. 377, CDR-L2 as depicted in SEQ ID NO. 378 and CDR-L3 as depicted in SEQ ID NO. 379 and CDR-H1 as depicted in SEQ ID NO. 374, CDR-H2 as depicted in SEQ ID NO. 375 and CDR-H3 as depicted in SEQ ID NO. 376;
(ag) CDR-L1 as depicted in SEQ ID NO. 388, CDR-L2 as depicted in SEQ ID NO. 389 and CDR-L3 as depicted in SEQ ID NO. 390 and CDR-H1 as depicted in SEQ ID NO. 385, CDR-H2 as depicted in SEQ ID NO. 386 and CDR-H3 as depicted in SEQ ID NO. 386;
(ah) CDR-L1 as depicted in SEQ ID NO. 399, CDR-L2 as depicted in SEQ ID NO. 400 and CDR-L3 as depicted in SEQ ID NO. 401 and CDR-H1 as depicted in SEQ ID NO. 396, CDR-H2 as depicted in SEQ ID NO. 397 and CDR-H3 as depicted in SEQ ID NO. 398;
(ai) CDR-L1 as depicted in SEQ ID NO. 410, CDR-L2 as depicted in SEQ ID NO. 411 and CDR-L3 as depicted in SEQ ID NO. 412 and CDR-H1 as depicted in SEQ ID NO. 407, CDR-H2 as depicted in SEQ ID NO. 408 and CDR-H3 as depicted in SEQ ID NO. 409;
(aj) CDR-L1 as depicted in SEQ ID NO. 421, CDR-L2 as depicted in SEQ ID NO. 422 and CDR-L3 as depicted in SEQ ID NO. 423 and CDR-H1 as depicted in SEQ ID NO. 418, CDR-H2 as depicted in SEQ ID NO. 419 and CDR-H3 as depicted in SEQ ID NO. 420;
(ak) CDR-L1 as depicted in SEQ ID NO. 432, CDR-L2 as depicted in SEQ ID NO. 433 and CDR-L3 as depicted in SEQ ID NO. 434 and CDR-H1 as depicted in SEQ ID NO. 429, CDR-H2 as depicted in SEQ ID NO. 430 and CDR-H3 as depicted in SEQ ID NO. 431;
(al) CDR-L1 as depicted in SEQ ID NO. 443, CDR-L2 as depicted in SEQ ID NO. 444 and CDR-L3 as depicted in SEQ ID NO. 445 and CDR-H1 as depicted in SEQ ID NO. 440, CDR-H2 as depicted in SEQ ID NO. 441 and CDR-H3 as depicted in SEQ ID NO. 442;
(am) CDR-L1 as depicted in SEQ ID NO. 454, CDR-L2 as depicted in SEQ ID NO. 455 and CDR-L3 as depicted in SEQ ID NO. 456 and CDR-H1 as depicted in SEQ ID NO. 451, CDR-H2 as depicted in SEQ ID NO. 452 and CDR-H3 as depicted in SEQ ID NO. 453;
(an) CDR-L1 as depicted in SEQ ID NO. 465, CDR-L2 as depicted in SEQ ID NO. 466 and CDR-L3 as depicted in SEQ ID NO. 467 and CDR-H1 as depicted in SEQ ID NO. 462, CDR-H2 as depicted in SEQ ID NO. 463 and CDR-H3 as depicted in SEQ ID NO. 464;
(ao) CDR-L1 as depicted in SEQ ID NO. 476, CDR-L2 as depicted in SEQ ID NO. 477 and CDR-L3 as depicted in SEQ ID NO. 478 and CDR-H1 as depicted in SEQ ID NO. 473, CDR-H2 as depicted in SEQ ID NO. 474 and CDR-H3 as depicted in SEQ ID NO. 475;
(ap) CDR-L1 as depicted in SEQ ID NO. 487, CDR-L2 as depicted in SEQ ID NO. 488 and CDR-L3 as depicted in SEQ ID NO. 489 and CDR-H1 as depicted in SEQ ID NO. 484, CDR-H2 as depicted in SEQ ID NO. 485 and CDR-H3 as depicted in SEQ ID NO. 486;
(aq) CDR-L1 as depicted in SEQ ID NO. 498, CDR-L2 as depicted in SEQ ID NO. 499 and CDR-L3 as depicted in SEQ ID NO. 500, and CDR-H1 as depicted in SEQ ID NO. 495, CDR-H2 as depicted in SEQ ID NO. 496 and CDR-H3 as depicted in SEQ ID NO. 497;
(ar) CDR-L1 as depicted in SEQ ID NO. 509, CDR-L2 as depicted in SEQ ID NO. 510 and CDR-L3 as depicted in SEQ ID NO. 511, and CDR-H1 as depicted in SEQ ID NO. 506, CDR-H2 as depicted in SEQ ID NO. 507 and CDR-H3 as depicted in SEQ ID NO. 508; and
(as) CDR-L1 as depicted in SEQ ID NO. 520, CDR-L2 as depicted in SEQ ID NO. 521 and CDR-L3 as depicted in SEQ ID NO. 522, and CDR-H1 as depicted in SEQ ID NO. 517, CDR-H2 as depicted in SEQ ID NO. 518 and CDR-H3 as depicted in SEQ ID NO. 519; wherein preferred are, for example,
(c) CDR-L1 as depicted in SEQ ID NO. 58, CDR-L2 as depicted in SEQ ID NO. 59 and CDR-L3 as depicted in SEQ ID NO. 60 and CDR-H1 as depicted in SEQ ID NO. 55, CDR-H2 as depicted in SEQ ID NO. 56 and CDR-H3 as depicted in SEQ ID NO. 57;
(n) CDR-L1 as depicted in SEQ ID NO. 179, CDR-L2 as depicted in SEQ ID NO. 180 and CDR-L3 as depicted in SEQ ID NO. 181, and CDR-H1 as depicted in SEQ ID NO. 176, CDR-H2 as depicted in SEQ ID NO. 177 and CDR-H3 as depicted in SEQ ID NO. 178;
(ac) CDR-L1 as depicted in SEQ ID NO. 344, CDR-L2 as depicted in SEQ ID NO. 345 and CDR-L3 as depicted in SEQ ID NO. 346 and CDR-H1 as depicted in SEQ ID NO. 341, CDR-H2 as depicted in SEQ ID NO. 342 and CDR-H3 as depicted in SEQ ID NO. 343; and
(aj) CDR-L1 as depicted in SEQ ID NO. 421, CDR-L2 as depicted in SEQ ID NO. 422 and CDR-L3 as depicted in SEQ ID NO. 423 and CDR-H1 as depicted in SEQ ID NO. 418, CDR-H2 as depicted in SEQ ID NO. 419 and CDR-H3 as depicted in SEQ ID NO. 420.

It is furthermore envisaged that the first binding domain of the antibody construct of the invention comprises a VH region and a VL region selected from the group consisting of:
(a) a VL region as depicted in SEQ ID NO. 40 and a VH region as depicted in SEQ ID NO. 39;
(b) a VL region as depicted in SEQ ID NO. 51 and a VH region as depicted in SEQ ID NO. 50;
(c) a VL region as depicted in SEQ ID NO. 62 and a VH region as depicted in SEQ ID NO. 61;
(d) a VL region as depicted in SEQ ID NO. 73 and a VH region as depicted in SEQ ID NO. 72;
(e) a VL region as depicted in SEQ ID NO. 84 and a VH region as depicted in SEQ ID NO. 83;
(f) a VL region as depicted in SEQ ID NO. 95 and a VH region as depicted in SEQ ID NO. 94;
(g) a VL region as depicted in SEQ ID NO. 106 and a VH region as depicted in SEQ ID NO. 105;
(h) a VL region as depicted in SEQ ID NO. 117 and a VH region as depicted in SEQ ID NO. 116;
(i) a VL region as depicted in SEQ ID NO. 128 and a VH region as depicted in SEQ ID NO. 127;
(j) a VL region as depicted in SEQ ID NO. 139 and a VH region as depicted in SEQ ID NO. 138;
(k) a VL region as depicted in SEQ ID NO. 150 and a VH region as depicted in SEQ ID NO. 149;
(l) a VL region as depicted in SEQ ID NO. 161 and a VH region as depicted in SEQ ID NO. 160;
(m) a VL region as depicted in SEQ ID NO. 172 and a VH region as depicted in SEQ ID NO. 171;
(n) a VL region as depicted in SEQ ID NO. 183 and a VH region as depicted in SEQ ID NO. 182;

(o) a VL region as depicted in SEQ ID NO. 194 and a VH region as depicted in SEQ ID NO. 193;
(p) a VL region as depicted in SEQ ID NO. 205 and a VH region as depicted in SEQ ID NO. 204;
(q) a VL region as depicted in SEQ ID NO. 216 and a VH region as depicted in SEQ ID NO. 215;
(r) a VL region as depicted in SEQ ID NO. 227 and a VH region as depicted in SEQ ID NO. 226;
(s) a VL region as depicted in SEQ ID NO. 238 and a VH region as depicted in SEQ ID NO. 237;
(t) a VL region as depicted in SEQ ID NO. 249 and a VH region as depicted in SEQ ID NO. 248;
(u) a VL region as depicted in SEQ ID NO. 260 and a VH region as depicted in SEQ ID NO. 259;
(v) a VL region as depicted in SEQ ID NO. 271 and a VH region as depicted in SEQ ID NO. 270;
(w) a VL region as depicted in SEQ ID NO. 282 and a VH region as depicted in SEQ ID NO. 281;
(x) a VL region as depicted in SEQ ID NO. 293 and a VH region as depicted in SEQ ID NO. 292;
(y) a VL region as depicted in SEQ ID NO. 304 and a VH region as depicted in SEQ ID NO. 303;
(z) a VL region as depicted in SEQ ID NO. 315 and a VH region as depicted in SEQ ID NO. 314;
(aa) a VL region as depicted in SEQ ID NO. 326 and a VH region as depicted in SEQ ID NO. 325;
(ab) a VL region as depicted in SEQ ID NO. 337 and a VH region as depicted in SEQ ID NO. 336;
(ac) a VL region as depicted in SEQ ID NO. 348 and a VH region as depicted in SEQ ID NO. 347;
(ad) a VL region as depicted in SEQ ID NO. 359 and a VH region as depicted in SEQ ID NO. 358;
(ae) a VL region as depicted in SEQ ID NO. 370 and a VH region as depicted in SEQ ID NO. 369;
(af) a VL region as depicted in SEQ ID NO. 381 and a VH region as depicted in SEQ ID NO. 380;
(ag) a VL region as depicted in SEQ ID NO. 392 and a VH region as depicted in SEQ ID NO. 391;
(ah) a VL region as depicted in SEQ ID NO. 403 and a VH region as depicted in SEQ ID NO. 402;
(ai) a VL region as depicted in SEQ ID NO. 414 and a VH region as depicted in SEQ ID NO. 413;
(aj) a VL region as depicted in SEQ ID NO. 425 and a VH region as depicted in SEQ ID NO. 424;
(ak) a VL region as depicted in SEQ ID NO. 436 and a VH region as depicted in SEQ ID NO. 435;
(al) a VL region as depicted in SEQ ID NO. 447 and a VH region as depicted in SEQ ID NO. 446;
(am) a VL region as depicted in SEQ ID NO. 458 and a VH region as depicted in SEQ ID NO. 457;
(an) a VL region as depicted in SEQ ID NO. 469 and a VH region as depicted in SEQ ID NO. 468;
(ao) a VL region as depicted in SEQ ID NO. 480 and a VH region as depicted in SEQ ID NO. 479;
(ap) a VL region as depicted in SEQ ID NO. 491 and a VH region as depicted in SEQ ID NO. 490;
(aq) a VL region as depicted in SEQ ID NO. 502 and a VH region as depicted in SEQ ID NO. 501;
(ar) a VL region as depicted in SEQ ID NO. 513 and a VH region as depicted in SEQ ID NO. 512; and
(as) a VL region as depicted in SEQ ID NO. 524 and a VH region as depicted in SEQ ID NO. 523.

It is furthermore envisaged that the first binding domain of the antibody construct of the invention comprises an amino acid sequence selected from the group consisting of those depicted in SEQ ID NOs: 41, 52, 63, 74, 85, 96, 107, 118, 129, 140, 151, 162, 173, 184, 195, 206, 217, 228, 239, 250, 261, 272, 283, 294, 305, 316, 327, 338, 349, 360, 371, 382, 393, 404, 415, 426, 437, 448, 459, 470, 481, 492, 503, 514, and 525 or having an amino acid sequence having at least 90, 91, 92, 93, 94 95, 96, 97, 98 or 99% identity to said sequences.

The invention further provides an antibody construct comprising or having an amino acid sequence (full bispecific antibody construct) selected from the group consisting of SEQ ID NO: 42, 43, 53, 54, 64, 65, 75, 76, 86, 87, 97, 98, 108, 109, 119, 120, 130, 131, 141, 142, 152, 153, 163, 164, 174, 175, 185, 186, 196, 197, 207, 208, 218, 219, 229, 230, 240, 241, 251, 252, 262, 263, 273, 274, 284, 285, 295, 296, 306, 307, 317, 318, 328, 329, 339, 340, 350, 351, 361, 362, 372, 373, 383, 384, 394, 395, 405, 406, 416, 417, 427, 428, 438, 439, 449, 450, 460, 461, 471, 472, 482, 483, 493, 494, 504, 505, 515, 516, 526 and 527, or having an amino acid sequence having at least 90, 91, 92, 93, 94 95, 96, 97, 98 or 99% identity to said sequences.

Covalent modifications of the antibody constructs are also included within the scope of this invention, and are generally, but not always, done post-translationally. For example, several types of covalent modifications of the antibody construct are introduced into the molecule by reacting specific amino acid residues of the antibody construct with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form 0-acetyl tyrosyl species and 3-nitro derivatives, respectively. Tyrosyl residues are iodinated using $^{125}$I or $^{131}$I to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for crosslinking the antibody constructs of the present invention to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates as described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antibody constructs included within the scope of this invention comprises altering the glycosylation pattern of the protein. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody construct is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the amino acid sequence of an antibody construct is preferably altered through changes at the DNA level, particularly by mutating the DNA encoding the polypeptide at preselected bases such that codons are generated that will translate into the desired amino acids.

Another means of increasing the number of carbohydrate moieties on the antibody construct is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330, and in Aplin and Wriston, 1981, CRC Crit. Rev. Biochem., pp. 259-306.

Removal of carbohydrate moieties present on the starting antibody construct may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, *Arch. Biochem. Biophys.* 259:52 and by Edge et al., 1981, *Anal. Biochem.* 118:131. Enzymatic cleavage of carbohydrate moieties on polypeptides can be achieved by the use of a variety of endo- and exo-glycosidases as described by Thotakura et al., 1987, Meth. Enzymol. 138:350. Glycosylation at potential glycosylation sites may be prevented by the use of the compound tunicamycin as described by Duskin et al., 1982, J. Biol. Chem. 257:3105. Tunicamycin blocks the formation of protein-N-glycoside linkages.

Other modifications of the antibody construct are also contemplated herein. For example, another type of covalent modification of the antibody construct comprises linking the antibody construct to various non-proteinaceous polymers, including, but not limited to, various polyols such as polyethylene glycol, polypropylene glycol, polyoxyalkylenes, or copolymers of polyethylene glycol and polypropylene glycol, in the manner set forth in U.S. Pat. Nos. 4,640,835; 4,496,689; 4,301,144; 4,670,417; 4,791,192 or 4,179,337. In addition, as is known in the art, amino acid substitutions may be made in various positions within the antibody construct, e.g. in order to facilitate the addition of polymers such as PEG.

In some embodiments, the covalent modification of the antibody constructs of the invention comprises the addition of one or more labels. The labelling group may be coupled to the antibody construct via spacer arms of various lengths to reduce potential steric hindrance. Various methods for labelling proteins are known in the art and can be used in performing the present invention. The term "label" or "labelling group" refers to any detectable label. In general, labels fall into a variety of classes, depending on the assay in which they are to be detected—the following examples include, but are not limited to:

a) isotopic labels, which may be radioactive or heavy isotopes, such as radioisotopes or radionuclides (e.g., $^{3}H$, $^{14}C$, $^{15}N$, $^{35}S$, $^{89}Zr$, $^{90}Y$, $^{99}Tc$, $^{111}In$, $^{125}I$, $^{131}I$)

b) magnetic labels (e.g., magnetic particles)
c) redox active moieties
d) optical dyes (including, but not limited to, chromophores, phosphors and fluorophores) such as fluorescent groups (e.g., FITC, rhodamine, lanthanide phosphors), chemiluminescent groups, and fluorophores which can be either "small molecule" fluors or proteinaceous fluors
e) enzymatic groups (e.g. horseradish peroxidase, β-galactosidase, luciferase, alkaline phosphatase)
f) biotinylated groups
g) predetermined polypeptide epitopes recognized by a secondary reporter (e.g., leucine zipper pair sequences, binding sides for secondary antibodies, metal binding domains, epitope tags, etc.)

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, *Lucifer* Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, OR), FITC, Rhodamine, and Texas Red (Pierce, Rockford, IL), Cy5, Cy5.5, Cy7 (Amersham Life Science, Pittsburgh, PA). Suitable optical dyes, including fluorophores, are described in Molecular Probes Handbook by Richard P. Haugland.

Suitable proteinaceous fluorescent labels also include, but are not limited to, green fluorescent protein, including a *Renilla, Ptilosarcus*, or *Aequorea* species of GFP (Chalfie et al., 1994, *Science* 263:802-805), EGFP (Clontech Laboratories, Inc., Genbank Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, *Biotechniques* 24:462-471; Heim et al., 1996, *Curr. Biol.* 6:178-182), enhanced yellow fluorescent protein (EYFP, Clontech Laboratories, Inc.), luciferase (Ichiki et al., 1993, *J. Immunol.* 150:5408-5417), β galactosidase (Nolan et al., 1988, *Proc. Natl. Acad. Sci. U.S.A.* 85:2603-2607) and *Renilla* (WO92/15673, WO95/07463, WO98/14605, WO98/26277, WO99/49019, U.S. Pat. Nos. 5,292,658; 5,418,155; 5,683,888; 5,741,668; 5,777,079; 5,804,387; 5,874,304; 5,876,995; 5,925,558).

The antibody construct of the invention may also comprise additional domains, which are e.g. helpful in the isolation of the molecule or relate to an adapted pharmacokinetic profile of the molecule. Domains helpful for the isolation of an antibody construct may be selected from peptide motives or secondarily introduced moieties, which can be captured in an isolation method, e.g. an isolation column. Non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. Strepll-tag) and His-tag. All herein disclosed antibody constructs may comprise a His-tag domain, which is generally known as a repeat of consecutive His residues in the amino acid sequence of a molecule, preferably of five, and more preferably of six His residues (hexa-histidine). The His-tag may be located e.g. at the N- or C-terminus of the antibody construct, preferably it is located at the C-terminus. Most preferably, a hexa-histidine tag (HHHHHH) (SEQ ID NO:16) is linked via peptide bond to the C-terminus of the antibody construct according to the invention. Additionally, a conjugate system of PLGA-PEG-PLGA may be combined with a poly-histidine tag for sustained release application and improved pharmacokinetic profile.

Amino acid sequence modifications of the antibody constructs described herein are also contemplated. For example, it may be desirable to improve the binding affinity and/or other biological properties of the antibody construct Amino acid sequence variants of the antibody constructs are prepared by introducing appropriate nucleotide changes into the antibody constructs nucleic acid, or by peptide synthesis. All of the below described amino acidacid sequence modifications should result in an antibody construct which still retains the desired biological activity (binding to MUC17 and to CD3) of the unmodified parental molecule.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I): leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gln, Gly, His, Met, Phe, Ser, Thr, Trp, and Tyr).

Amino acid modifications include, for example, deletions from, and/or insertions into, and/or substitutions of, residues within the amino acid sequences of the antibody constructs. Any combination of deletion, insertion, and substitution is made to arrive at the final construct, provided that the final construct possesses the desired characteristics. The amino acid changes also may alter post-translational processes of the antibody constructs, such as changing the number or position of glycosylation sites.

For example, 1, 2, 3, 4, 5, or 6 amino acids may be inserted, substituted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted, substituted or deleted in each of the FRs. Preferably, amino acid sequence insertions into the antibody construct include amino- and/or carboxyl-terminal fusions ranging in length from 1, 2, 3, 4, 5, 6, 7, 8, 9 or 10 residues to polypeptides containing a hundred or more residues, as well as intra-sequence insertions of single or multiple amino acid residues. Corresponding modifications may also performed within the third domain of the antibody construct of the invention. An insertional variant of the antibody construct of the invention includes the fusion to the N-terminus or to the C-terminus of the antibody construct of an enzyme or the fusion to a polypeptide.

The sites of greatest interest for substitutional mutagenesis include (but are not limited to) the CDRs of the heavy and/or light chain, in particular the hypervariable regions, but FR alterations in the heavy and/or light chain are also contemplated. The substitutions are preferably conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

A useful method for identification of certain residues or regions of the antibody constructs that are preferred locations for mutagenesis is called "alanine scanning mutagenesis" as described by Cunningham and Wells in Science, 244: 1081-1085 (1989). Here, a residue or group of target residues within the antibody construct is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions are then refined by introducing further or other variants at, or for, the sites of substitution. Thus, while the site or region for introducing an amino acid sequence variation is predetermined, the nature of the mutation per se needs not to be predetermined. For example, to analyze or optimize the performance of a mutation at a given site, alanine scanning or random mutagenesis may be conducted at a target codon or region, and the expressed antibody construct variants are screened for the optimal combination of desired activity. Techniques for making substitution mutations at predetermined sites in the DNA having a known sequence are well known, for example, M13 primer mutagenesis and PCR mutagenesis. Screening of the mutants is done using assays of antigen binding activities, such as MUC17 or CD3 binding.

Generally, if amino acids are substituted in one or more or all of the CDRs of the heavy and/or light chain, it is preferred that the then-obtained "substituted" sequence is at least 60% or 65%, more preferably 70% or 75%, even more preferably 80% or 85%, and particularly preferably 90% or 95% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody construct may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 3, below) is envisaged as long as the antibody construct retains its capability to bind to MUC17 via the first domain and to CD3 epsilon via the second domain and/or its CDRs have an identity to the then substituted sequence (at least 60% or 65%, more preferably 70% or 75%, even more preferably 80% or 85%, and particularly preferably 90% or 95% identical to the "original" CDR sequence).

Conservative substitutions are shown in Table 3 under the heading of "preferred substitutions". If such substitutions result in a change in biological activity, then more substantial changes, denominated "exemplary substitutions" in Table 3, or as further described below in reference to amino acid classes, may be introduced and the products screened for a desired characteristic.

TABLE 3

Amino acid substitutions

| Original | Exemplary Substitutions | Preferred Substitutions |
|---|---|---|
| Ala (A) | val, leu, ile | Val |
| Arg (R) | lys, gln, asn | Lys |
| Asn (N) | gln, his, asp, lys, arg | Gln |
| Asp (D) | glu, asn | Glu |
| Cys (C) | ser, ala | ser |
| Gln (Q) | asn, glu | asn |
| Glu (E) | asp, gln | asp |
| Gly (G) | Ala | ala |
| His (H) | asn, gln, lys, arg | arg |
| Ile (I) | leu, val, met, ala, phe | leu |
| Leu (L) | norleucine, ile, val, met, ala | ile |
| Lys (K) | arg, gln, asn | arg |
| Met (M) | leu, phe, ile | leu |
| Phe (F) | leu, val, ile, ala, tyr | tyr |
| Pro (P) | Ala | ala |
| Ser (S) | Thr | thr |
| Thr (T) | Ser | ser |
| Trp (W) | tyr, phe | tyr |
| Tyr (Y) | trp, phe, thr, ser | phe |
| Val (V) | ile, leu, met, phe, ala | leu |

Substantial modifications in the biological properties of the antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr; asn, gln (3) acidic: asp, glu; (4) basic: his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the antibody construct may be substituted, generally with serine, to improve the oxidative stability of the molecule and prevent aberrant crosslinking Conversely, cysteine bond(s) may be added to the antibody to improve its stability (particularly where the antibody is an antibody fragment such as an Fv fragment).

For amino acid sequences, sequence identity and/or similarity is determined by using standard techniques known in the art, including, but not limited to, the local sequence identity algorithm of Smith and Waterman, 1981, *Adv. Appl. Math.* 2:482, the sequence identity alignment algorithm of Needleman and Wunsch, 1970, *J. Mol. Biol.* 48:443, the search for similarity method of Pearson and Lipman, 1988, *Proc. Nat. Acad. Sci. U.S.A.* 85:2444, computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., 1984, *Nucl. Acid Res.* 12:387-395, preferably using the default settings, or by inspection. Preferably, percent identity is calculated by FastDB based upon the following parameters: mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, 1987, *J. Mol. Evol.* 35:351-360; the method is similar to that described by Higgins and Sharp, 1989, *CABIOS* 5:151-153. Useful PILEUP parameters including a default gap weight of 3.00, a default gap length weight of 0.10, and weighted end gaps.

Another example of a useful algorithm is the BLAST algorithm, described in: Altschul et al., 1990, *J. Mol. Biol.* 215:403-410; Altschul et al., 1997, *Nucleic Acids Res.* 25:3389-3402; and Karin et al., 1993, *Proc. Natl. Acad. Sci. U.S.A.* 90:5873-5787. A particularly useful BLAST program is the WU-BLAST-2 program which was obtained from Altschul et al., 1996, *Methods in Enzymology* 266:460-480. WU-BLAST-2 uses several search parameters, most of which are set to the default values. The adjustable parameters are set with the following values: overlap span=1, overlap fraction=0.125, word threshold (T)=II. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., 1993, *Nucl. Acids Res.* 25:3389-3402. Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

Generally, the amino acid homology, similarity, or identity between individual variant CDRs or VH/VL sequences are at least 60% to the sequences depicted herein, and more typically with preferably increasing homologies or identities of at least 65% or 70%, more preferably at least 75% or 80%, even more preferably at least 85%, 90%, 91%, 92%, 93%, 94%, 95%, 96%, 97%, 98%, 99%, and almost 100%. In a similar manner, "percent (%) nucleic acid sequence identity" with respect to the nucleic acid sequence of the binding proteins identified herein is defined as the percentage of nucleotide residues in a candidate sequence that are identical with the nucleotide residues in the coding sequence of the antibody construct. A specific method utilizes the BLASTN module of WU-BLAST-2 set to the default parameters, with overlap span and overlap fraction set to 1 and 0.125, respectively.

Generally, the nucleic acid sequence homology, similarity, or identity between the nucleotide sequences encoding individual variant CDRs or VH/VL sequences and the nucleotide sequences depicted herein are at least 60%, and more typically with preferably increasing homologies or identities of at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99%, and almost 100%. Thus, a "variant CDR" or a "variant VH/VL region" is one with the specified homology, similarity, or identity to the parent CDR/VH/VL of the invention, and shares biological function, including, but not limited to, at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR or VH/VL.

In one embodiment, the percentage of identity to human germline of the antibody constructs according to the invention is ≥70% or ≥75%, more preferably ≥80% or ≥85%, even more preferably ≥90%, and most preferably ≥91%, ≥92%, ≥93%, ≥94%, ≥95% or even ≥96%. Identity to human antibody germline gene products is thought to be an important feature to reduce the risk of therapeutic proteins to elicit an immune response against the drug in the patient during treatment. Hwang & Foote ("Immunogenicity of engineered antibodies"; Methods 36 (2005) 3-10) demonstrate that the reduction of non-human portions of drug antibody constructs leads to a decrease of risk to induce anti-drug antibodies in the patients during treatment. By comparing an exhaustive number of clinically evaluated antibody drugs and the respective immunogenicity data, the trend is shown that humanization of the V-regions of antibodies makes the protein less immunogenic (average 5.1% of patients) than antibodies carrying unaltered non-human V regions (average 23.59% of patients). A higher degree of identity to human V sequences is hence desirable for V-region based protein therapeutics in the form of antibody constructs. For this purpose of determining the germline identity, the V-regions of VL can be aligned with the amino acid sequences of human germline V segments and J segments (http://vbase.mrc-cpe.cam.ac.uk/) using Vector NTI software and the amino acid sequence calculated by dividing the identical amino acid residues by the total number of amino acid residues of the VL in percent. The same can be for the VH segments (http://vbase.mrc-cpe.cam.ac.uk/) with the exception that the VH CDR3 may be excluded due to its high diversity and a lack of existing human germline VH CDR3 alignment partners. Recombinant techniques can then be used to increase sequence identity to human antibody germline genes.

In a further embodiment, the bispecific antibody constructs of the present invention exhibit high monomer yields under standard research scale conditions, e.g., in a standard two-step purification process. Preferably the monomer yield of the antibody constructs according to the invention is ≥0.25 mg/L supernatant, more preferably ≥0.5 mg/L, even more preferably ≥1 mg/L, and most preferably ≥3 mg/L supernatant.

Likewise, the yield of the dimeric antibody construct isoforms and hence the monomer percentage (i.e., monomer:(monomer+dimer)) of the antibody constructs can be determined. The productivity of monomeric and dimeric antibody constructs and the calculated monomer percentage can e.g. be obtained in the SEC purification step of culture supernatant from standardized research-scale production in roller bottles. In one embodiment, the monomer percentage of the antibody constructs is ≥80%, more preferably ≥85%, even more preferably ≥90%, and most preferably ≥95%.

In one embodiment, the antibody constructs have a preferred plasma stability (ratio of $EC_{50}$ with plasma to $EC_{50}$ w/o plasma) of ≤5 or ≤4, more preferably ≤3.5 or ≤3, even more preferably ≤2.5 or ≤2, and most preferably ≤1.5 or ≤1. The plasma stability of an antibody construct can be tested by incubation of the construct in human plasma at 37° C. for 24 hours followed by $EC_{50}$ determination in a $^{51}$chromium release cytotoxicity assay. The effector cells in the cytotoxicity assay can be stimulated enriched human CD8 positive T cells. Target cells can e.g. be CHO cells transfected with human MUC17. The effector to target cell (E:T) ratio can be chosen as 10:1 or 5:1. The human plasma pool used for this purpose is derived from the blood of healthy donors collected by EDTA coated syringes. Cellular components are removed by centrifugation and the upper plasma phase is collected and subsequently pooled. As control, antibody constructs are diluted immediately prior to the cytotoxicity assay in RPMI-1640 medium. The plasma stability is calculated as ratio of $EC_{50}$ (after plasma incubation) to $EC_{50}$ (control).

It is furthermore preferred that the monomer to dimer conversion of antibody constructs of the invention is low. The conversion can be measured under different conditions and analyzed by high performance size exclusion chromatography. For example, incubation of the monomeric isoforms of the antibody constructs can be carried out for 7 days at 37° C. and concentrations of e.g. 100 µg/ml or 250 µg/ml in an incubator. Under these conditions, it is preferred that the antibody constructs of the invention show a dimer percentage that is ≤5%, more preferably ≤4%, even more preferably ≤3%, even more preferably ≤2.5%, even more preferably ≤2%, even more preferably ≤1.5%, and most preferably ≤1% or ≤0.5% or even 0%.

It is also preferred that the bispecific antibody constructs of the present invention present with very low dimer conversion after a number of freeze/thaw cycles. For example, the antibody construct monomer is adjusted to a concentration of 250 µg/ml e.g. in generic formulation buffer and subjected to three freeze/thaw cycles (freezing at −80° C. for 30 min followed by thawing for 30 min at room temperature), followed by high performance SEC to determine the percentage of initially monomeric antibody construct, which had been converted into dimeric antibody construct. Preferably the dimer percentages of the bispecific antibody constructs are ≤5%, more preferably ≤4%, even more preferably ≤3%, even more preferably ≤2.5%, even more preferably ≤2%, even more preferably ≤1.5%, and most preferably ≤1% or even ≤0.5%, for example after three freeze/thaw cycles.

The bispecific antibody constructs of the present invention preferably show a favorable thermostability with aggregation temperatures ≥45° C. or ≥50° C., more preferably ≥52° C. or ≥54° C., even more preferably ≥56° C. or ≥57° C., and most preferably ≥58° C. or ≥59° C. The thermostability parameter can be determined in terms of antibody aggregation temperature as follows: Antibody solution at a concentration 250 µg/ml is transferred into a single use cuvette and placed in a Dynamic Light Scattering (DLS) device. The sample is heated from 40° C. to 70° C. at a heating rate of 0.5° C./min with constant acquisition of the measured radius. Increase of radius indicating melting of the protein and aggregation is used to calculate the aggregation temperature of the antibody.

Alternatively, temperature melting curves can be determined by Differential Scanning calorimetry (DSC) to determine intrinsic biophysical protein stabilities of the antibody constructs. These experiments are performed using a MicroCal LLC (Northampton, MA, U.S.A) VP-DSC device. The energy uptake of a sample containing an antibody construct is recorded from 20° C. to 90° C. compared to a sample containing only the formulation buffer. The antibody constructs are adjusted to a final concentration of 250 µg/ml e.g. in SEC running buffer. For recording of the respective melting curve, the overall sample temperature is increased stepwise. At each temperature T energy uptake of the sample and the formulation buffer reference is recorded. The difference in energy uptake Cp (kcal/mole/° C.) of the sample minus the reference is plotted against the respective temperature. The melting temperature is defined as the temperature at the first maximum of energy uptake.

The MUC17×CD3 bispecific antibody constructs of the invention are also envisaged to have a turbidity (as measured by OD340 after concentration of purified monomeric antibody construct to 2.5 mg/ml and overnight incubation) of ≤0.2, preferably of ≤0.15, more preferably of ≤0.12, even more preferably of ≤0.1, and most preferably of ≤0.08.

In a further embodiment the antibody construct according to the invention is stable at physiologic or slightly lower pH, i.e. about pH 7.4 to 6.0. The more tolerant the antibody construct behaves at unphysiologic pH such as about pH 6.0, the higher is the recovery of the antibody construct eluted from an ion exchange column relative to the total amount of loaded protein. Recovery of the antibody construct from an ion (e.g., cation) exchange column at about pH 6.0 is preferably ≥30%, more preferably ≥40%, more preferably ≥50%, even more preferably ≥60%, even more preferably ≥70%, even more preferably ≥80%, even more preferably ≥90%, even more preferably ≥95%, and most preferably ≥99%.

It is furthermore envisaged that the bispecific antibody constructs of the present invention exhibit therapeutic efficacy or anti-tumor activity. This can e.g. be assessed in a study as disclosed in the following generalized example of an advanced stage human tumor xenograft model:

On day 1 of the study, $5 \times 10^6$ cells of a human target cell antigen (here: MUC17) positive cancer cell line are subcutaneously injected in the right dorsal flank of female NOD/SCID mice. When the mean tumor volume reaches about 100 mm$^3$, in vitro expanded human CD3 positive T cells are transplanted into the mice by injection of about $2 \times 10^7$ cells into the peritoneal cavity of the animals. Mice of vehicle control group 1 do not receive effector cells and are used as an untransplanted control for comparison with vehicle control group 2 (receiving effector cells) to monitor the impact of T cells alone on tumor growth. The antibody treatment starts when the mean tumor volume reaches about 200 mm$^3$. The mean tumor size of each treatment group on the day of treatment start should not be statistically different from any other group (analysis of variance). Mice are treated with 0.5 mg/kg/day of a MUC17×CD3 bispecific antibody construct by intravenous bolus injection for about 15 to 20 days. Tumors are measured by caliper during the study and progress evaluated by intergroup comparison of tumor volumes (TV). The tumor growth inhibition T/C [%] is determined by calculating TV as T/C %=100×(median TV of analyzed group)/(median TV of control group 2).

The skilled person knows how to modify or adapt certain parameters of this study, such as the number of injected tumor cells, the site of injection, the number of transplanted human T cells, the amount of bispecific antibody constructs to be administered, and the timelines, while still arriving at a meaningful and reproducible result. Preferably, the tumor growth inhibition T/C [%] is ≤70 or ≤60, more preferably ≤50 or ≤40, even more preferably ≤30 or ≤20 and most preferably ≤10 or ≤5 or even ≤2.5. Tumor growth inhibition is preferably close to 100%.

In a preferred embodiment of the antibody construct of the invention the antibody construct is a single chain antibody construct.

Also in a preferred embodiment of the antibody construct of the invention said third domain comprises in an amino to carboxyl order:

hinge-CH2-CH3-linker-hinge-CH2-CH3.

In one embodiment of the invention each of said polypeptide monomers of the third domain has an amino acid sequence that is at least 90% identical to a sequence selected from the group consisting of: SEQ ID NO: 17-24. In a preferred embodiment or the invention each of said polypeptide monomers has an amino acid sequence selected from SEQ ID NO: 17-24.

Also in one embodiment of the invention the CH2 domain of one or preferably each (both) polypeptide monomers of the third domain comprises an intra domain cysteine disulfide bridge. As known in the art the term "cysteine disulfide bridge" refers to a functional group with the general structure R—S—S—R. The linkage is also called an SS-bond or a disulfide bridge and is derived by the coupling of two thiol groups of cysteine residues. It is particularly preferred for the antibody construct of the invention that the cysteines forming the cysteine disulfide bridge in the mature antibody construct are introduced into the amino acid sequence of the CH2 domain corresponding to 309 and 321 (Kabat numbering).

In one embodiment of the invention a glycosylation site in Kabat position 314 of the CH2 domain is removed. It is preferred that this removal of the glycosylation site is achieved by a N314X substitution, wherein X is any amino acid excluding Q. Said substitution is preferably a N314G. In a more preferred embodiment, said CH2 domain additionally comprises the following substitutions (position according to Kabat) V321C and R309C (these substitutions introduce the intra domain cysteine disulfide bridge at Kabat positions 309 and 321).

It is assumed that the preferred features of the antibody construct of the invention compared e.g. to the bispecific heteroFc antibody construct known in the art (FIG. 1b) may be inter alia related to the introduction of the above described modifications in the CH2 domain. Thus, it is preferred for the construct of the invention that the CH2 domains in the third domain of the antibody construct of the invention comprise the intra domain cysteine disulfide bridge at Kabat positions 309 and 321 and/or the glycosylation site at Kabat position 314 is removed, preferably by a N314G substitution.

In a further preferred embodiment of the invention the CH2 domains in the third domain of the antibody construct of the invention comprise the intra domain cysteine disulfide bridge at Kabat positions 309 and 321 and the glycosylation site at Kabat position 314 is removed by a N314G substitution. Most preferably, the polypeptide monomer of the third domain of the antibody construct of the invention has an amino acid sequence selected from the group consisting of SEQ ID NO: 17 and 18.

In one embodiment the invention provides an antibody construct, wherein:
(i) the first domain comprises two antibody variable domains and the second domain comprises two antibody variable domains;
(ii) the first domain comprises one antibody variable domain and the second domain comprises two antibody variable domains;
(iii) the first domain comprises two antibody variable domains and the second domain comprises one antibody variable domain; or
(iv) the first domain comprises one antibody variable domain and the second domain comprises one antibody variable domain.

Accordingly, the first and the second domain may be binding domains comprising each two antibody variable domains such as a VH and a VL domain. Examples for such binding domains comprising two antibody variable domains where described herein above and comprise e.g. Fv fragments, scFv fragments or Fab fragments described herein above. Alternatively either one or both of those binding domains may comprise only a single variable domain Examples for such single domain binding domains where described herein above and comprise e.g. nanobodies or single variable domain antibodies comprising merely one variable domain, which may be VHH, VH or VL, that specifically bind an antigen or epitope independently of other V regions or domains.

In a preferred embodiment of the antibody construct of the invention first and second domain are fused to the third domain via a peptide linker. Preferred peptide linker have been described herein above and are characterized by the amino acid sequence Gly-Gly-Gly-Gly-Ser, i.e. Gly$_4$Ser (SEQ ID NO: 1), or polymers thereof, i.e. (Gly$_4$Ser)x, where x is an integer of 1 or greater (e.g. 2 or 3). A particularly preferred linker for the fusion of the first and second domain to the third domain is depicted in SEQ ID NO: 1.

In a preferred embodiment the antibody construct of the invention is characterized to comprise in an amino to carboxyl order:
(a) the first domain;
(b) a peptide linker having an amino acid sequence selected from the group consisting of SEQ ID NO: 1-3;
(c) the second domain;
(d) a peptide linker having an amino acid sequence selected from the group consisting of SEQ ID NO: 1, 2, 3, 9, 10, 11 and 12;
(e) the first polypeptide monomer of the third domain;
(f) a peptide linker having an amino acid sequence selected from the group consisting of SEQ ID NO: 5, 6, 7 and 8; and
(g) the second polypeptide monomer of the third domain The antibody construct of the present invention comprises a first domain which binds to MUC17, preferably to the extracellular domain (ECD) of MUC17. It is understood that the term "binding to the extracellular domain of MUC17", in the context of the present invention, implies that the binding domain binds to MUC17 expressed on the surface of a target cell. The first domain according to the invention hence preferably binds to MUC17 when it is expressed by naturally expressing cells or cell lines, and/or by cells or cell lines transformed or (stably/transiently) transfected with MUC17. In a preferred embodiment the first binding domain also binds to MUC17 when MUC17 is used as a "target" or "ligand" molecule in an in vitro binding assay such as BIAcore or Scatchard. The "target cell" can be any prokaryotic or eukaryotic cell expressing MUC17 on its surface; preferably the target cell is a cell that is part of the human or animal body, such as a specific MUC17 expressing cancer or tumor cell.

Preferably, the first binding domain binds to human MUC17/MUC17 ECD. In a further preferred embodiment, it binds to macaque MUC17/MUC17 ECD. According to the most preferred embodiment, it binds to both the human and the macaque MUC17/MUC17 ECD. The "MUC17 extracellular domain" or "MUC17 ECD" refers to the MUC17 region or sequence which is essentially free of transmembrane and cytoplasmic domains of MUC17. It will be understood by the skilled artisan that the transmembrane domain identified for the MUC17 polypeptide of the present invention is identified pursuant to criteria routinely employed in the art for identifying that type of hydrophobic domain. The exact boundaries of a transmembrane domain may vary but most likely by no more than about 5 amino acids at either end of the domain specifically mentioned herein.

Preferred binding domains which bind to MUC17 are disclosed in WO 2010/037836, and WO 2011/121110. Any binding domain for MUC17 described in these applications may be used in the context of the present invention.

In one aspect of the invention the antibody construct comprises in an amino to carboxyl order:
- (a) the first domain having an amino acid sequence selected from the group consisting of SEQ ID NOs: 50, 56, 68, 74, 86, 92, 104, 110, 122, 128, 140, 146, 158, 164, 176, 182, 194, 200, 212, 218, 230, 236, 248, 254, 266, 272, 284, 290, 302, 308, 320, 335, 350, 365, 380, 395, 410, 425, 440, 455, 470;
- (b) a peptide linker having an amino acid sequence selected from the group consisting of SEQ ID NOs: 1-3;
- (c) the second domain having an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567 (SEQ ID NOs: 586-605 herein) or as depicted in SEQ ID NO: 15;
- (d) a peptide linker having an amino acid sequence selected from the group consisting of SEQ ID NOs: 1, 2, 3, 9, 10, 11 and 12;
- (e) the first polypeptide monomer of the third domain having a polypeptide sequence selected from the group consisting of SEQ ID NOs: 17-24;
- (f) a peptide linker having an amino acid sequence selected from the group consisting of SEQ ID NOs: 5, 6, 7 and 8; and
- (g) the second polypeptide monomer of the third domain having a polypeptide sequence selected from the group consisting of SEQ ID NOs: 17-24.

In line with this preferred embodiment, the first and second domain which are fused via a peptide linker to a single chain polypeptide comprise a sequence selected from the group consisting of: SEQ ID NO: 51, 57, 69, 75, 87, 93, 105, 111, 123, 129, 141, 147, 159, 165, 177, 183, 195, 201, 213, 219, 231, 237, 249, 255, 267, 273, 285, 291, 303, 309, 321, 324, 336, 339, 351, 354, 366, 369, 381, 384, 396, 399, 411, 414, 426, 429, 441, 444, 456, 459, 471 and 474.

In one aspect the antibody construct of the invention is characterized by having an amino acid sequence selected from the group consisting of: SEQ ID NO: 52, 53, 58, 59, 70, 71, 76, 77, 88, 89, 94, 95, 106, 107, 112, 113, 124, 125, 130, 131, 142, 143, 148, 149, 160, 161, 166, 167, 178, 179, 184, 185, 196, 197, 202, 203, 214, 215, 220, 221, 232, 233, 238, 239, 250, 251, 256, 257, 268, 269, 274, 275, 286, 287, 292, 293, 304 305, 310, 311, 322, 323, 325, 326, 337, 338, 340, 341, 352, 353, 355, 356, 367, 368, 370, 371, 382, 383, 385, 386, 397, 398, 400, 401, 412, 413, 415, 416, 427, 428, 430, 431, 442, 443, 445, 446, 457, 458, 460, 461, 472, 473, 475 and 476.

The invention further provides a polynucleotide/nucleic acid molecule encoding an antibody construct of the invention. A polynucleotide is a biopolymer composed of 13 or more nucleotide monomers covalently bonded in a chain. DNA (such as cDNA) and RNA (such as mRNA) are examples of polynucleotides with distinct biological function. Nucleotides are organic molecules that serve as the monomers or subunits of nucleic acid molecules like DNA or RNA. The nucleic acid molecule or polynucleotide can be double stranded and single stranded, linear and circular. It is preferably comprised in a vector which is preferably comprised in a host cell. Said host cell is, e.g. after transformation or transfection with the vector or the polynucleotide of the invention, capable of expressing the antibody construct. For that purpose the polynucleotide or nucleic acid molecule is operatively linked with control sequences.

The genetic code is the set of rules by which information encoded within genetic material (nucleic acids) is translated into proteins. Biological decoding in living cells is accomplished by the ribosome which links amino acids in an order specified by mRNA, using tRNA molecules to carry amino acids and to read the mRNA three nucleotides at a time. The code defines how sequences of these nucleotide triplets, called codons, specify which amino acid will be added next during protein synthesis. With some exceptions, a three-nucleotide codon in a nucleic acid sequence specifies a single amino acid. Because the vast majority of genes are encoded with exactly the same code, this particular code is often referred to as the canonical or standard genetic code. While the genetic code determines the protein sequence for a given coding region, other genomic regions can influence when and where these proteins are produced.

Furthermore, the invention provides a vector comprising a polynucleotide/nucleic acid molecule of the invention. A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding side. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding side is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Transfection" is the process of deliberately introducing nucleic acid molecules or polynucleotides (including vectors) into target cells. The term is mostly used for non-viral methods in eukaryotic cells. Transduction is often used to describe virus-mediated transfer of nucleic acid molecules or polynucleotides. Transfection of animal cells typically involves opening transient pores or "holes" in the cell membrane, to allow the uptake of material. Transfection can be carried out using calcium phosphate, by electroporation, by cell squeezing or by mixing a cationic lipid with the material to produce liposomes, which fuse with the cell membrane and deposit their cargo inside.

The term "transformation" is used to describe non-viral transfer of nucleic acid molecules or polynucleotides (including vectors) into bacteria, and also into non-animal eukaryotic cells, including plant cells. Transformation is hence the genetic alteration of a bacterial or non-animal eukaryotic cell resulting from the direct uptake through the cell membrane(s) from its surroundings and subsequent incorporation of exogenous genetic material (nucleic acid molecules). Transformation can be effected by artificial means. For transformation to happen, cells or bacteria must be in a state of competence, which may occur as a time-limited response to environmental conditions such as starvation and cell density.

Moreover, the invention provides a host cell transformed or transfected with the polynucleotide/nucleic acid molecule or with the vector of the invention. As used herein, the terms "host cell" or "recipient cell" are intended to include any individual cell or cell culture that can be or has/have been recipients of vectors, exogenous nucleic acid molecules, and polynucleotides encoding the antibody construct of the present invention; and/or recipients of the antibody construct itself. The introduction of the respective material into the cell is carried out by way of transformation, transfection and the like. The term "host cell" is also intended to include progeny or potential progeny of a single cell. Because certain modifications may occur in succeeding generations due to either natural, accidental, or deliberate mutation or due to environmental influences, such progeny may not, in fact, be completely identical (in morphology or in genomic or total DNA complement) to the parent cell, but is still included within the scope of the term as used herein. Suitable host cells include prokaryotic or eukaryotic cells, and also include but are not limited to bacteria, yeast cells, fungi cells, plant cells, and animal cells such as insect cells and mammalian cells, e.g., murine, rat, macaque or human The antibody construct of the invention can be produced in bacteria. After expression, the antibody construct of the invention is isolated from the *E. coli* cell paste in a soluble fraction and can be purified through, e.g., affinity chromatography and/or size exclusion. Final purification can be carried out similar to the process for purifying antibody expressed e.g., in CHO cells.

In addition to prokaryotes, eukaryotic microbes such as filamentous fungi or yeast are suitable cloning or expression hosts for the antibody construct of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe, Kluyveromyces* hosts such as *K. lactis, K. fragilis* (ATCC 12424), *K. bulgaricus* (ATCC 16045), *K. wickeramii* (ATCC 24178), *K. waltii* (ATCC 56500), *K. drosophilarum* (ATCC 36906), *K. thermotolerans*, and *K. marxianus; yarrowia* (EP 402 226); *Pichia pastoris* (EP 183 070); *Candida; Trichoderma reesia* (EP 244 234); *Neurospora crassa; Schwanniomyces* such as *Schwanniomyces occidentalis*; and filamentous fungi such as *Neurospora, Penicillium, Tolypocladium*, and *Aspergillus* hosts such as *A. nidulans* and *A. niger*.

Suitable host cells for the expression of glycosylated antibody construct of the invention are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, *petunia*, tomato, *Arabidopsis* and tobacco can also be used as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36: 59 (1977)); baby hamster kidney cells (BHK, ATCC CCL 10); Chinese hamster ovary cells/-DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2,1413 8065); mouse mammary tumor (MMT 060562, ATCC CCLS 1); TRI cells (Mather et al., Annals N. Y Acad. Sci. (1982) 383: 44-68); MRC 5 cells; FS4 cells; and a human hepatoma line (Hep G2).

In a further embodiment the invention provides a process for the production of an antibody construct of the invention, said process comprising culturing a host cell of the invention under conditions allowing the expression of the antibody construct of the invention and recovering the produced antibody construct from the culture.

As used herein, the term "culturing" refers to the in vitro maintenance, differentiation, growth, proliferation and/or propagation of cells under suitable conditions in a medium. The term "expression" includes any step involved in the production of an antibody construct of the invention including, but not limited to, transcription, post-transcriptional modification, translation, post-translational modification, and secretion.

When using recombinant techniques, the antibody construct can be produced intracellularly, in the periplasmic space, or directly secreted into the medium. If the antibody construct is produced intracellularly, as a first step, the particulate debris, either host cells or lysed fragments, are removed, for example, by centrifugation or ultrafiltration. Carter et al., *Bio/Technology* 10: 163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody construct of the invention prepared from the host cells can be recovered or purified using, for example, hydroxylapatite chromatography, gel electrophoresis, dialysis, and affinity chromatography. Other techniques for protein purification such as fractionation on an ion-exchange column, ethanol precipitation, Reverse Phase HPLC, chromatography on silica, chromatography on heparin SEPHAROSE™, chromatography on an anion or cation exchange resin (such as a polyaspartic acid column), chromato-focusing, SDS-PAGE, and ammonium sulfate precipitation are also available depending on the antibody to be recovered. Where the antibody construct of the invention comprises a CH3 domain, the Bakerbond ABX resin (J. T. Baker, Phillipsburg, NJ) is useful for purification.

Affinity chromatography is a preferred purification technique. The matrix to which the affinity ligand is attached is most often agarose, but other matrices are available. Mechanically stable matrices such as controlled pore glass or poly (styrenedivinyl) benzene allow for faster flow rates and shorter processing times than can be achieved with agarose.

Moreover, the invention provides a pharmaceutical composition comprising an antibody construct of the invention or an antibody construct produced according to the process of the invention. It is preferred for the pharmaceutical composition of the invention that the homogeneity of the antibody construct is $\geq 80\%$, more preferably $\geq 81\%$, $\geq 82\%$, $\geq 83\%$, $\geq 84\%$, or $\geq 85\%$, further preferably $\geq 86\%$, $\geq 87\%$, $\geq 88\%$, $\geq 89\%$, or $\geq 90\%$, still further preferably, $\geq 91\%$, $\geq 92\%$, $\geq 93\%$, $\geq 94\%$, or $\geq 95\%$ and most preferably $\geq 96\%$, $\geq 97\%$, $\geq 98\%$ or $\geq 99\%$.

As used herein, the term "pharmaceutical composition" relates to a composition which is suitable for administration to a patient, preferably a human patient. The particularly preferred pharmaceutical composition of this invention comprises one or a plurality of the antibody construct(s) of the invention, preferably in a therapeutically effective amount. Preferably, the pharmaceutical composition further comprises suitable formulations of one or more (pharmaceutically effective) carriers, stabilizers, excipients, diluents, solubilizers, surfactants, emulsifiers, preservatives and/or adjuvants. Acceptable constituents of the composition are preferably nontoxic to recipients at the dosages and concentrations employed. Pharmaceutical compositions of the invention include, but are not limited to, liquid, frozen, and lyophilized compositions.

The inventive compositions may comprise a pharmaceutically acceptable carrier. In general, as used herein, "pharmaceutically acceptable carrier" means any and all aqueous and non-aqueous solutions, sterile solutions, solvents, buffers, e.g. phosphate buffered saline (PBS) solutions, water, suspensions, emulsions, such as oil/water emulsions, various types of wetting agents, liposomes, dispersion media and coatings, which are compatible with pharmaceutical administration, in particular with parenteral administration. The use of such media and agents in pharmaceutical compositions is well known in the art, and the compositions comprising such carriers can be formulated by well-known conventional methods.

Certain embodiments provide pharmaceutical compositions comprising the antibody construct of the invention and further one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter.

In certain embodiments, the pharmaceutical composition may contain formulation materials for the purpose of modifying, maintaining or preserving, e.g., the pH, osmolarity, viscosity, clarity, color, isotonicity, odor, sterility, stability, rate of dissolution or release, adsorption or penetration of the composition (see, REMINGTON'S PHARMACEUTICAL SCIENCES, 18" Edition, (A. R. Genrmo, ed.), 1990, Mack Publishing Company). In such embodiments, suitable formulation materials may include, but are not limited to:

amino acids such as glycine, alanine, glutamine, asparagine, threonine, proline, 2-phenylalanine, including charged amino acids, preferably lysine, lysine acetate, arginine, glutamate and/or histidine antimicrobials such as antibacterial and antifungal agents antioxidants such as ascorbic acid, methionine, sodium sulfite or sodium hydrogen-sulfite;

buffers, buffer systems and buffering agents which are used to maintain the composition at physiological pH or at a slightly lower pH, preferably a lower pH of 4.0 to 6.5; examples of buffers are borate, bicarbonate, Tris-HCl, citrates, phosphates or other organic acids, succinate, phosphate, and histidine; for example Tris buffer of about pH 7.0-8.5;

non-aqueous solvents such as propylene glycol, polyethylene glycol, vegetable oils such as olive oil, and injectable organic esters such as ethyl oleate;

aqueous carriers including water, alcoholic/aqueous solutions, emulsions or suspensions, including saline and buffered media;

biodegradable polymers such as polyesters;

bulking agents such as mannitol or glycine;

chelating agents such as ethylenediamine tetraacetic acid (EDTA);

isotonic and absorption delaying agents;

complexing agents such as caffeine, polyvinylpyrrolidone, beta-cyclodextrin or hydroxypropyl-beta-cyclodextrin)

fillers;

monosaccharides; disaccharides; and other carbohydrates (such as glucose, mannose or dextrins); carbohydrates may be non-reducing sugars, preferably trehalose, sucrose, octasulfate, sorbitol or xylitol;

(low molecular weight) proteins, polypeptides or proteinaceous carriers such as human or bovine serum albumin, gelatin or immunoglobulins, preferably of human origin;

coloring and flavouring agents;

sulfur containing reducing agents, such as glutathione, thioctic acid, sodium thioglycolate, thioglycerol, [alpha]-monothioglycerol, and sodium thio sulfate diluting agents;

emulsifying agents;

hydrophilic polymers such as polyvinylpyrrolidone)
salt-forming counter-ions such as sodium;
preservatives such as antimicrobials, anti-oxidants, chelating agents, inert gases and the like; examples are: benzalkonium chloride, benzoic acid, salicylic acid, thimerosal, phenethyl alcohol, methylparaben, propylparaben, chlorhexidine, sorbic acid or hydrogen peroxide);
metal complexes such as Zn-protein complexes;
solvents and co-solvents (such as glycerin, propylene glycol or polyethylene glycol);
sugars and sugar alcohols, such as trehalose, sucrose, octasulfate, mannitol, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; and polyhydric sugar alcohols;
suspending agents;
surfactants or wetting agents such as pluronics, PEG, sorbitan esters, polysorbates such as polysorbate 20, polysorbate, triton, tromethamine, lecithin, cholesterol, tyloxapal; surfactants may be detergents, preferably with a molecular weight of >1.2 KD and/or a polyether, preferably with a molecular weight of >3 KD; non-limiting examples for preferred detergents are Tween 20, Tween 40, Tween 60, Tween 80 and Tween 85; non-limiting examples for preferred polyethers are PEG 3000, PEG 3350, PEG 4000 and PEG 5000;
stability enhancing agents such as sucrose or sorbitol;
tonicity enhancing agents such as alkali metal halides, preferably sodium or potassium chloride, mannitol sorbitol;
parenteral delivery vehicles including sodium chloride solution, Ringer's dextrose, dextrose and sodium chloride, lactated Ringer's, or fixed oils;
intravenous delivery vehicles including fluid and nutrient replenishers, electrolyte replenishers (such as those based on Ringer's dextrose).

In the context of the present invention, a pharmaceutical composition, which is preferably a liquid composition or may be a solid composition obtained by lyophilisation or may be a reconstituted liquid composition comprises
(a) an antibody construct comprising at least three domains, wherein:
a first domain binds to a target cell surface antigen and has an isoelectric point (pI) in the range of 4 to 9.5;
a second domain binds to a second antigen; and has a pI in the range of 8 to 10, preferably 8.5 to 9.0; and
optionally a third domain comprises two polypeptide monomers, each comprising a hinge, a CH2 domain and a CH3 domain, wherein said two polypeptide monomers are fused to each other via a peptide linker;
(b) at least one buffer agent;
(c) at least one saccharide; and
(d) at least one surfactant;
and wherein the pH of the pharmaceutical composition is in the range of 3.5 to 6.

It is further envisaged in the context of the present invention that the at least one buffer agent is present at a concentration range of 5 to 200 mM, more preferably at a concentration range of 10 to 50 mM. It is envisaged in the context of the present invention that the at least one saccharide is selected from the group consisting of monosaccharide, disaccharide, cyclic polysaccharide, sugar alcohol, linear branched dextran or linear non-branched dextran. It is also envisaged in the context of the present invention that the disaccharide is selected from the group consisting of sucrose, trehalose and mannitol, sorbitol, and combinations thereof. It is further envisaged in the context of the present invention that the sugar alcohol is sorbitol. It is envisaged in the context of the present invention that the at least one saccharide is present at a concentration in the range of 1 to 15% (m/V), preferably in a concentration range of 9 to 12% (m/V).

It is also envisaged in the context of the present invention that the at least one surfactant is selected from the group consisting of polysorbate 20, polysorbate 40, polysorbate 60, polysorbate 80, poloxamer 188, pluronic F68, triton X-100, polyoxyethylen, PEG 3350, PEG 4000 and combinations thereof. It is further envisaged in the context of the present invention that the at least one surfactant is present at a concentration in the range of 0.004 to 0.5% (m/V), preferably in the range of 0.001 to 0.01% (m/V). It is envisaged in the context of the present invention that the pH of the composition is in the range of 4.0 to 5.0, preferably 4.2. It is also envisaged in the context of the present invention that the pharmaceutical composition has an osmolarity in the range of 150 to 500 mOsm. It is further envisaged in the context of the present invention that the pharmaceutical composition further comprises an excipient selected from the group consisting of, one or more polyol and one or more amino acid. It is envisaged in the context of the present invention that said one or more excipient is present in the concentration range of 0.1 to 15 (w/V).

It is also envisaged in the context of the present invention that the pharmaceutical composition comprises
(a) the antibody construct as discussed above,
(b) 10 mM glutamate or acetate,
(c) 9% (m/V) sucrose or 6% (m/V) sucrose and 6% (m/V) hydroxypropyl-β-cyclodextrin,
(d) 0.01% (m/V) polysorbate 80
and wherein the pH of the liquid pharmaceutical composition is 4.2.

It is further envisaged in the context of the present invention that the antibody construct is present in a concentration range of 0.1 to 8 mg/ml, preferably of 0.2-2.5 mg/ml, more preferably of 0.25-1.0 mg/ml.

It is evident to those skilled in the art that the different constituents of the pharmaceutical composition (e.g., those listed above) can have different effects, for example, and amino acid can act as a buffer, a stabilizer and/or an antioxidant; mannitol can act as a bulking agent and/or a tonicity enhancing agent; sodium chloride can act as delivery vehicle and/or tonicity enhancing agent; etc.

It is envisaged that the composition of the invention may comprise, in addition to the polypeptide of the invention defined herein, further biologically active agents, depending on the intended use of the composition. Such agents may be drugs acting on the gastro-intestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the antibody construct of the present invention is applied in a co-therapy, i.e., in combination with another anti-cancer medicament.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antibody construct of the invention. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In certain embodiments, the antibody construct of the invention compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the antibody construct of the invention may be formulated as a lyophilizate using appropriate excipients such as sucrose.

When parenteral administration is contemplated, the therapeutic compositions for use in this invention may be provided in the form of a pyrogen-free, parenterally acceptable aqueous solution comprising the desired antibody construct of the invention in a pharmaceutically acceptable vehicle. A particularly suitable vehicle for parenteral injection is sterile distilled water in which the antibody construct of the invention is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antibody construct.

Additional pharmaceutical compositions will be evident to those skilled in the art, including formulations involving the antibody construct of the invention in sustained- or controlled-delivery/release formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481), copolymers of L-glutamic acid and gamma ethyl-L-glutamate (Sidman et al., 1983, Biopolymers 2:547-556), poly (2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(-)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949.

The antibody construct may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Another aspect of the invention includes self-buffering antibody construct of the invention formulations, which can be used as pharmaceutical compositions, as described in international patent application WO 06138181A2 (PCT/US2006/022599). A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution" in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions", Pharm Biotechnol. 13: 159-75 (2002), see particularly the parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention. As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic". Destabilizing solutes are referred to as "chaotropic". Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in the antibody construct of the invention formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations. Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the antibody construct of the invention formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product. Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188. Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of the antibody construct of the invention formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard. Antioxidants can damage proteins. For instance, reducing agents, such as glutathione in particular, can disrupt intramolecular disulfide linkages. Thus, antioxidants for use in the invention are selected to, among other things, eliminate or sufficiently reduce the possibility of themselves damaging proteins in the formulation.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins. Magnesium ions (10-120 mM) can be used to inhibit isomerization of aspartic acid to isoaspartic acid. $Ca^{+2}$ ions (up to 100 mM) can increase the stability of human deoxyribonuclease. $Mg^{+2}$, $Mn^{+2}$, and $Zn^{+2}$, however, can destabilize rhDNase. Similarly, $Ca^{+2}$ and $Sr^{+2}$ can stabilize Factor VIII, it can be destabilized by $Mg^{+2}$, $Mn^{+2}$ and $Zn^{+2}$, $Cu^{+2}$ and $Fe^{+2}$, and its aggregation can be increased by $Al^{+3}$ ions.

Embodiments of the antibody construct of the invention formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized—dual chamber cartridge, Pharmacia & Upjohn) contain phenol while Somatrope (Eli Lilly) is formulated with m-cresol. Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As may be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

The antibody constructs disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody construct are prepared by methods known in the art, such as described in Epstein et al., Proc. Natl. Acad. Sci. USA, 82: 3688 (1985); Hwang et al., Proc. Natl Acad. Sci. USA, 77: 4030 (1980); U.S. Pat. Nos. 4,485,045 and 4,544,545; and WO 97/38731. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody construct of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above. It is an envisaged characteristic of the antibody constructs of the present invention provided with the specific FC modality that they comprise, for example, differences in pharmacokinetic behavior. A half-life extended targeting antibody construct according to the present invention preferably shows a surprisingly increased residence time in vivo in comparison to "canonical" non-HLE versions of said antibody construct.

"Half-life" means the time where 50% of an administered drug are eliminated through biological processes, e.g. metabolism, excretion, etc. By "hepatic first-pass metabolism" is meant the propensity of a drug to be metabolized upon first contact with the liver, i.e. during its first pass through the liver. "Volume of distribution" means the degree of retention of a drug throughout the various compartments of the body, like e.g. intracellular and extracellular spaces, tissues and organs, etc. and the distribution of the drug within these compartments. "Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma. "Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetic parameters of bispecific antibody constructs exhibiting cross-species specificity, which may be determined in preclinical animal testing in non-chimpanzee primates as outlined above, are also set forth e.g. in the publication by Schlereth et al. (Cancer Immunol. Immunother. 20 (2005), 1-12).

In a preferred aspect of the invention the pharmaceutical composition is stable for at least four weeks at about −20° C. As apparent from the appended examples the quality of an antibody construct of the invention vs. the quality of corresponding state of the art antibody constructs may be tested using different systems. Those tests are understood to be in line with the "ICH Harmonised Tripartite Guideline: *Stability Testing of Biotechnological/Biological Products*

Q5C and Specifications: Test procedures and Acceptance Criteria for Biotech Biotechnological/Biological Products Q6B" and, thus are elected to provide a stability-indicating profile that provides certainty that changes in the identity, purity and potency of the product are detected. It is well accepted that the term purity is a relative term. Due to the effect of glycosylation, deamidation, or other heterogeneities, the absolute purity of a biotechnological/biological product should be typically assessed by more than one method and the purity value derived is method-dependent. For the purpose of stability testing, tests for purity should focus on methods for determination of degradation products.

For the assessment of the quality of a pharmaceutical composition comprising an antibody construct of the invention may be analyzed e.g. by analyzing the content of soluble aggregates in a solution (HMWS per size exclusion). It is preferred that stability for at least four weeks at about −20° C. is characterized by a content of less than 1.5% HMWS, preferably by less than 1% HMWS.

A preferred formulation for the antibody construct as a pharmaceutical composition may e.g. comprise the components of a formulation as described below:

Formulation:
potassium phosphate, L-arginine hydrochloride, trehalose dihydrate, polysorbate 80 at pH 6.0

Other examples for the assessment of the stability of an antibody construct of the invention in form of a pharmaceutical composition are provided in the appended examples 4-12. In those examples embodiments of antibody constructs of the invention are tested with respect to different stress conditions in different pharmaceutical formulations and the results compared with other half-life extending (HLE) formats of bispecific T cell engaging antibody construct known from the art. In general, it is envisaged that antibody constructs provided with the specific FC modality according to the present invention are typically more stable over a broad range of stress conditions such as temperature and light stress, both compared to antibody constructs provided with different HLE formats and without any HLE format (e.g. "canonical" antibody constructs). Said temperature stability may relate both to decreased (below room temperature including freezing) and increased (above room temperature including temperatures up to or above body temperature) temperature. As the person skilled in the art will acknowledge, such improved stability with regard to stress, which is hardly avoidable in clinical practice, makes the antibody construct safer because less degradation products will occur in clinical practice. In consequence, said increased stability means increased safety.

One embodiment provides the antibody construct of the invention or the antibody construct produced according to the process of the invention for use in the prevention, treatment or amelioration of a cancer correlating with MUC17 expression or MUC17 overexpression, such as prostate cancer.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient having a disease as specified herein below, by the administration of an antibody construct according to the invention to a subject in need thereof. Such an improvement may also be seen as a slowing or stopping of the progression of the patient's disease. The term "prevention" as used herein means the avoidance of the occurrence or re-occurrence of a patient having a tumor or cancer or a metastatic cancer as specified herein below, by the administration of an antibody construct according to the invention to a subject in need thereof.

The term "disease" refers to any condition that would benefit from treatment with the antibody construct or the pharmaceutic composition described herein. This includes chronic and acute disorders or diseases including those pathological conditions that predispose the mammal to the disease in question.

A "neoplasm" is an abnormal growth of tissue, usually but not always forming a mass. When also forming a mass, it is commonly referred to as a "tumor". Neoplasms or tumors or can be benign, potentially malignant (pre-cancerous), or malignant. Malignant neoplasms are commonly called cancer. They usually invade and destroy the surrounding tissue and may form metastases, i.e., they spread to other parts, tissues or organs of the body. Hence, the term "metatstatic cancer" encompasses metastases to other tissues or organs than the one of the original tumor. Lymphomas and leukemias are lymphoid neoplasms. For the purposes of the present invention, they are also encompassed by the terms "tumor" or "cancer".

The term "viral disease" describes diseases, which are the result of a viral infection of a subject.

The term "immunological disorder" as used herein describes in line with the common definition of this term immunological disorders such as autoimmune diseases, hypersensitivities, immune deficiencies.

In one embodiment the invention provides a method for the treatment or amelioration of a cancer correlating with MUC17 expression or MUC17 overexpression, comprising the step of administering to a subject in need thereof the antibody construct of the invention, or the antibody construct produced according to the process of the invention. The MUC17×CD3 bispecific single chain antibody is particularly advantageous for the therapy of cancer, preferably solid tumors, more preferably carcinomas and prostate cancer.

The terms "subject in need" or those "in need of treatment" includes those already with the disorder, as well as those in which the disorder is to be prevented. The subject in need or "patient" includes human and other mammalian subjects that receive either prophylactic or therapeutic treatment.

The antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration.

Formulations and compositions thus may be designed in accordance with the invention for delivery by any suitable route of administration. In the context of the present invention, the routes of administration include, but are not limited to topical routes (such as epicutaneous, inhalational, nasal, opthalmic, auricular/aural, vaginal, mucosal);

enteral routes (such as oral, gastrointestinal, sublingual, sublabial, buccal, rectal); and parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions and the antibody construct of this invention are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos. 4,475,196; 4,439,196; 4,447,224; 4,447, 233; 4,486,194; 4,487,603; 4,596,556; 4,790,824; 4,941,880; 5,064,413; 5,312,335; 5,312,335; 5,383,851; and 5,399,163.

In particular, the present invention provides for an uninterrupted administration of the suitable composition. As a non-limiting example, uninterrupted or substantially uninterrupted, i.e. continuous administration may be realized by a small pump system worn by the patient for metering the influx of therapeutic agent into the body of the patient. The pharmaceutical composition comprising the antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of the antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may also be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

The compositions of the present invention can be administered to the subject at a suitable dose which can be determined e.g. by dose escalating studies by administration of increasing doses of the antibody construct of the invention exhibiting cross-species specificity described herein to non-chimpanzee primates, for instance macaques. As set forth above, the antibody construct of the invention exhibiting cross-species specificity described herein can be advantageously used in identical form in preclinical testing in non-chimpanzee primates and as drug in humans. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts or doses effective for this use will depend on the condition to be treated (the indication), the delivered antibody construct, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect.

A typical dosage may range from about 0.1 µg/kg to up to about 30 mg/kg or more, depending on the factors mentioned above. In specific embodiments, the dosage may range from 1.0 µg/kg up to about 20 mg/kg, optionally from 10 µg/kg up to about 10 mg/kg or from 100 µg/kg up to about 5 mg/kg.

A therapeutic effective amount of an antibody construct of the invention preferably results in a decrease in severity of disease symptoms, an increase in frequency or duration of disease symptom-free periods or a prevention of impairment or disability due to the disease affliction. For treating diseases correlating with MUC17 expression as described herein above, a therapeutically effective amount of the antibody construct of the invention, here: an anti-MUC17/anti-CD3 antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy The pharmaceutical composition can be administered as a sole therapeutic or in combination with additional therapies such as anti-cancer therapies as needed, e.g. other proteinaceous and non-proteinaceous drugs. These drugs may be administered simultaneously with the composition comprising the antibody construct of the invention as defined herein or separately before or after administration of said antibody construct in timely defined intervals and doses.

The term "effective and non-toxic dose" as used herein refers to a tolerable dose of an inventive antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The term "toxicity" as used herein refers to the toxic effects of a drug manifested in adverse events or severe adverse events. These side events may refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

Finally, the invention provides a kit comprising an antibody construct of the invention or produced according to the process of the invention, a pharmaceutical composition of the invention, a polynucleotide of the invention, a vector of the invention and/or a host cell of the invention.

In the context of the present invention, the term "kit" means two or more components—one of which corresponding to the antibody construct, the pharmaceutical composition, the vector or the host cell of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the antibody construct or the pharmaceutical composition of the present invention in an appropriate dosage for administration (see above). The kit may additionally contain directions for use (e.g. in the form of a leaflet or instruction manual), means for administering the antibody construct of the present invention such as a syringe, pump, infuser or the like, means for reconstituting the antibody construct of the invention and/or means for diluting the antibody construct of the invention.

The invention also provides kits for a single-dose administration unit. The kit of the invention may also contain a first recipient comprising a dried/lyophilized antibody construct and a second recipient comprising an aqueous formulation. In certain embodiments of this invention, kits containing single-chambered and multi-chambered pre-filled syringes (e.g., liquid syringes and lyosyringes) are provided.

It is noted that as used herein, the singular forms "a", "an", and "the", include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within 20%, preferably within 10%, and more preferably within 5% of a given value or range. It includes, however, also the concrete number, e.g., about 20 includes 20.

The term "less than" or "greater than" includes the concrete number. For example, less than 20 means less than or equal to. Similarly, more than or greater than means more than or equal to, or greater than or equal to, respectively.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

It should be understood that this invention is not limited to the particular methodology, protocols, material, reagents, and substances, etc., described herein and as such can vary. The terminology used herein is for the purpose of describing particular embodiments only, and is not intended to limit the scope of the present invention, which is defined solely by the claims.

All publications and patents cited throughout the text of this specification (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention. To the extent the material incorporated by reference contradicts or is inconsistent with this specification, the specification will supersede any such material.

A better understanding of the present invention and of its advantages will be obtained from the following examples, offered for illustrative purposes only. The examples are not intended to limit the scope of the present invention in any way.

EXAMPLES

Example 1: Evaluation of MUC17 Cell Surface Expression

Figure 3A:
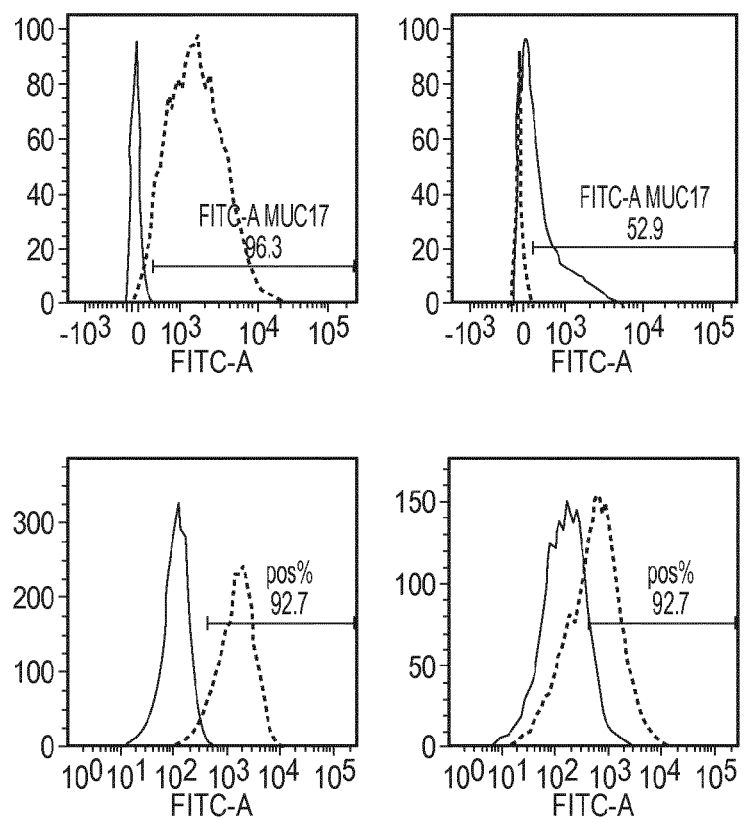
FIG. 3: MUC17 is expressed in gastric, pancreatic and colorectal cancer cell lines. MUC17 cell surface protein expression was determined by flow cytometry of live cells and are depicted as FACS readouts (A). MUC17 mRNA levels in cancer cell lines were determined by quantitative polymerase chain reaction (qPCR). Values are normalized to those of a constitutively expressed gene (B).
Figure 3B:
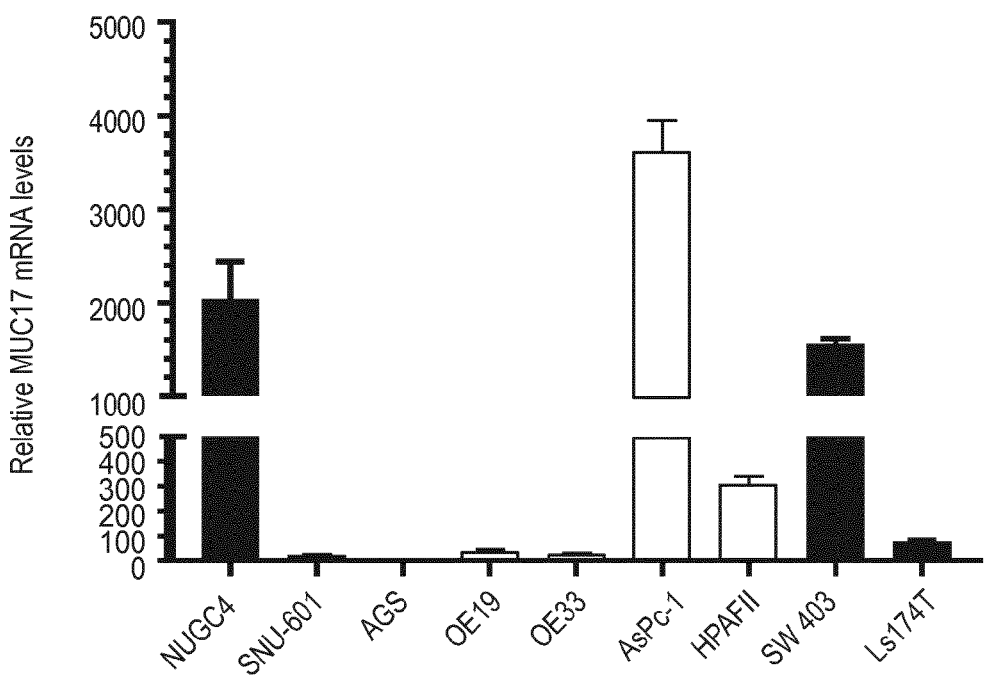

Cell surface levels of MUC17 were determined by flow cytometry, using a QIFIkit (Dako). Adherent cells were lifted using a non-enzymatic cell dissociation buffer (Cell-stripper, Corning and then stained with the anti-MUC17 antibody 4C11. The 4C11 antibody is a monoclonal antibody generated from immunization of B6 mice with a DNA construct encompassing the EGF-SEA-EGF region of MUC17 (aa 4131-4493). MUC17 was detected by incubation with a secondary antibody conjugated to FITC and analyzed by flow cytometry. Relative antibody binding capacity was determined by QIFIkit (Dako) using bead samples provided in the kit as standards. Results are depicted in FIG. 3 (A) MUC17 gene expression levels in cancer cell lines were determined by quantitative polymerase chain reaction (qPCR) using methods and probes from Applied Biosystems/Thermo Fisher. RNA was isolated from cancer cell lines and then transcribed to cDNA. The MUC17 cDNA was amplified with probes specific to MUC17, using qPCR. Gene expression levels of MUC17 were normalized to those for a constitutively expressed gene such and depicted in FIG. 3 (B)

Figure 4A:
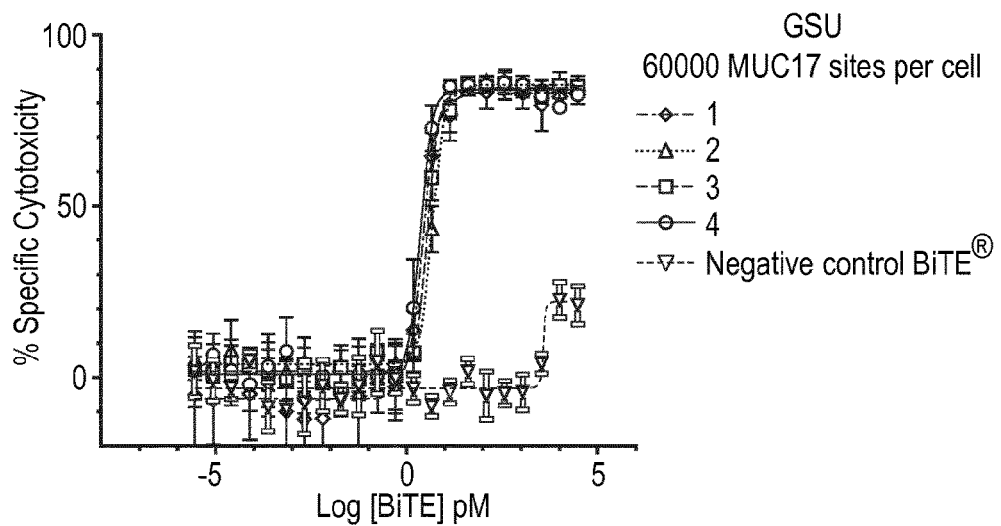
FIG. 4: Cytotoxicity assay on three different MUC17 bearing cell lines with different MUC17 expression (A: GSU, B: NUGC-4 and C: Ls174T). Tested constructs are 1=32-G6; 2=1-B6; 3=2-C2 and 4=8-B7. Construct 8-B7 is slightly favorable in terms of cytotoxicity.
Figure 4B:
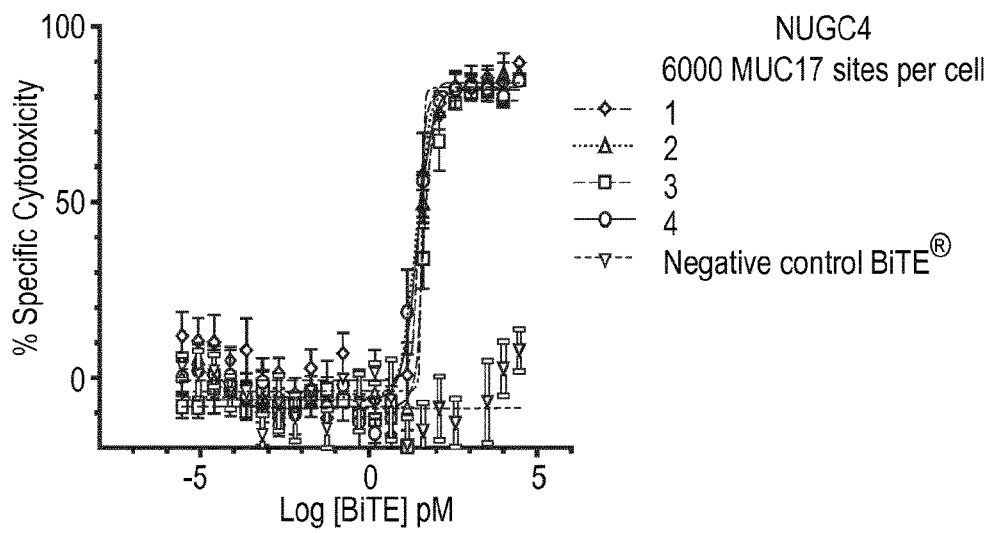
Figure 4C:
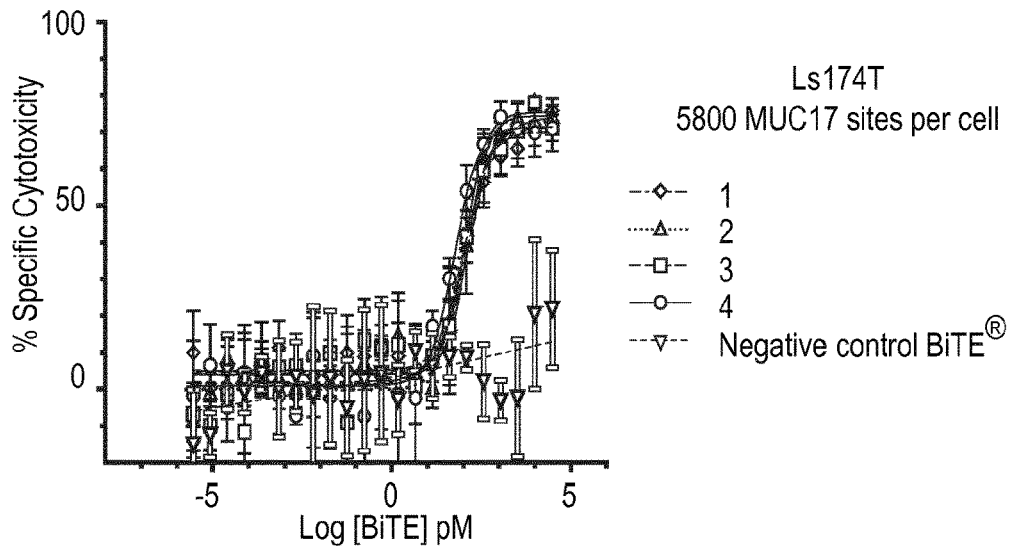
Figure 5A:
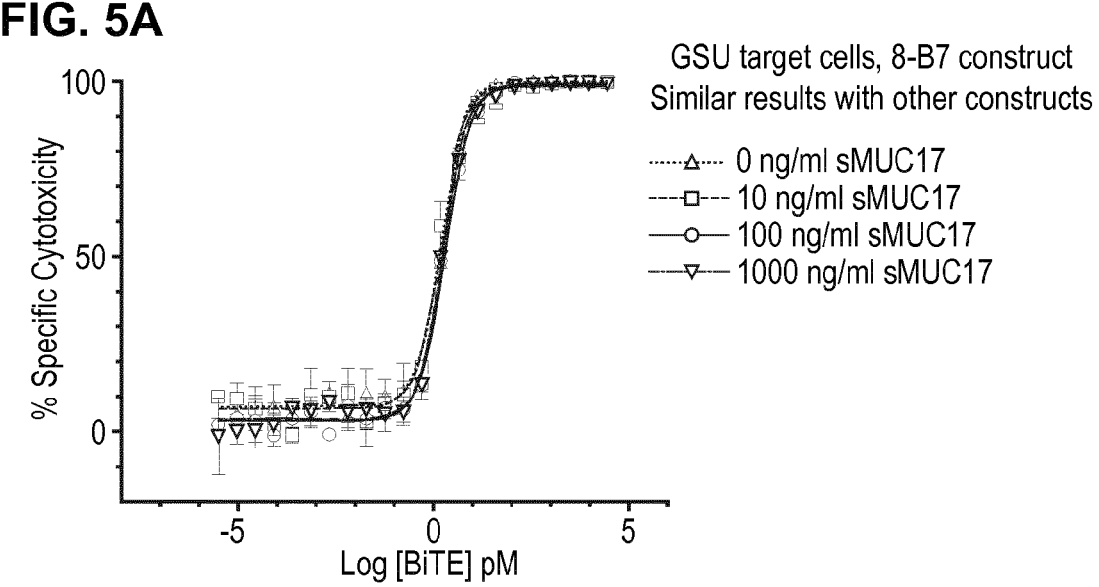
FIG. 5: Soluble MUC17 protein (sMUC17, aa 4131-4243 Uniprot) was added into TDCC assays at 0-1000 ng/ml and activity of the MUC17-scFc bispecific antibody constructs was assessed after 48 h incubation (target cells GSU (A) or NUGC-4 (B), 10:1 human T cells to target cells, readout by Steady Glo). Addition of sMUC17 did not impact the cytotoxic activity of the bispecific antibody constructs.
Figure 5B:
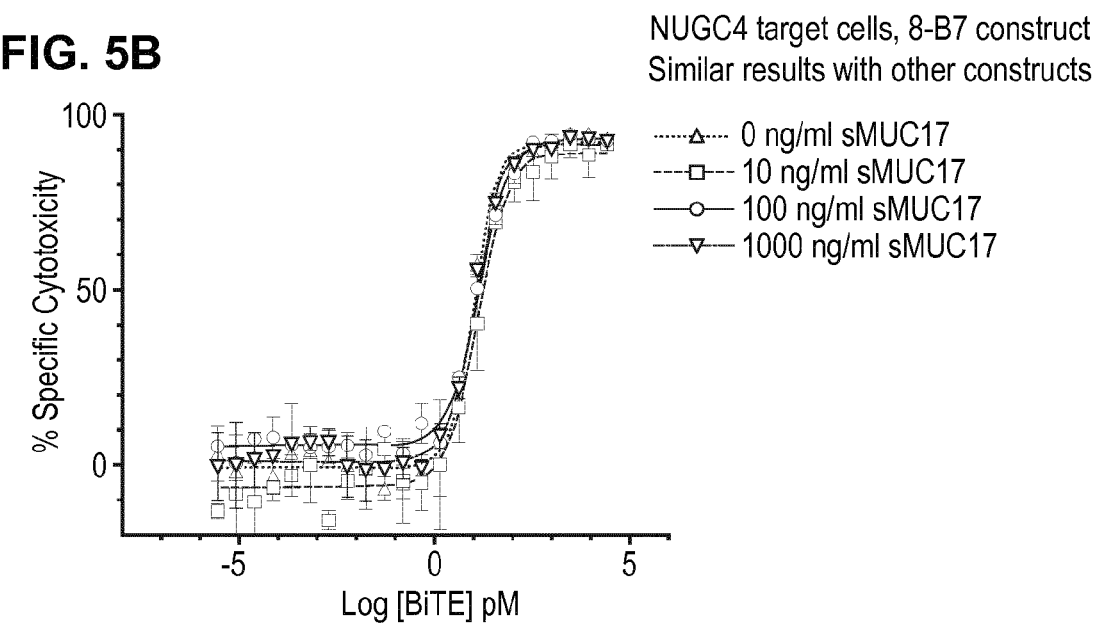

Example 2: Evaluation of MUC17 Bispecific Antibody Constructs In Vitro Efficacy Cell activity of MUC17 HLE antibody constructs was evaluated in T cell-dependent cytotoxicity (TDCC) assays. Effector cells were obtained from commercial sources, such as AllCells or Cepheus Biosciences, Inc. Human pan-T cells, human PBMC or PBMC from cynomolgus monkey were incubated at 10:1 or 5:1 with target cells expressing human or cynomolgus monkey MUC17 in the presence of a dose range of antibody constructs. After 48 h incubation, cell cytotoxicity was assessed using a luminescence assay (Cell T-glo or Steady-glo (Promega)), or high content imaging (Cellomics ArrayScan) as a readout for cellular cytotoxicity. Results are depicted in FIGS. 4 and 5.

Example 3: Xenograft Study to Evaluate In Vivo Efficacy of MUC17 Bispecific Antibody Construct The objective of the Xenograft study was to assess the anti-tumor activity of a half-life extended MUC17/CD3 bispecific antibody construct following intravenous administration in an advanced stage subcutaneous GSU-luc Xenograft model of human gastric cancer in female NOD/SCID mice.

Preparation of the target and effector cells for inoculation

Target Cells:

Human gastric carcinoma cells GSU, lentivirally transduced with vector LV417-Luc, to stably express firefly luciferase (GSU-luc) were harvested, centrifuged, washed with cold DPBS, counted and adjusted to a concentration of $5 \times 10^7$ cells/mL. A total of $5 \times 10^6$ cells/mouse was injected subcutaneously (SC) into the right dorsal flank of female NOD/SCID mice (Vendor: Envigo) in a final volume of 100 μL.

Effector Cells:

Human T cells were isolated from fresh blood of a healthy donor (#0801), enriched for CD3$^+$ T cells using the Pan T Cell Isolation Kit (#130-096-535) and activated and expanded in vitro using the human T Cell Activation/Expansion Kit (#130-091-441, both Miltenyi Biotec) in accordance with the manufacturer's instructions.

On the day of injection, T cells were counted, isolated from beads and washed 2× with cold DPBS. Cell number were adjusted to $1 \times 10^8$ cells/mL and stored on ice until injection. A total of $2 \times 10^7$ cells/mouse were injected into the peritoneal cavity (IP) in a final volume of 200 μL. Cells was stored on ice prior to injection. Experimental design Animals received MUC17 bispecific antibody constructor control item by intravenous (IV) bolus injection (into the tail vein). Mice were treated according to Table 4.

TABLE 4

Study Design Efficacy Study

| Group | Mice/Group | Target Cells/Mouse (SC) | Effector Cells/Mouse (IP) | Treatment | RoA | Dose Level (mg/kg) | Dose Volume (mL) | Treatment days |
|---|---|---|---|---|---|---|---|---|
| 1 | 5 | $5 \times 10^6$ GSU-luc | — | Control item | IV | 0 | 0.1 | 12, 19 |
| 2 | 10 | $5 \times 10^6$ GSU-luc | $2 \times 10^7$ CD3$^+$ | Control item | IV | 0 | 0.1 | 12, 19 |
| 3 | 10 | $5 \times 10^6$ GSU-luc | $2 \times 10^7$ CD3$^+$ | MUC17 bispecific construct | IV | 2.5 | 0.1 | 12, 19, 26 |

TABLE 4-continued

Study Design Efficacy Study

| Group | Mice/ Group | Target Cells/ Mouse (SC) | Effector Cells/ Mouse (IP) | Treatment | RoA | Dose Level (mg/kg) | Dose Volume (mL) | Treatment days |
|---|---|---|---|---|---|---|---|---|
| 4 | 10 | 5 × 10⁶ GSU-luc | 2 × 10⁷ CD3⁺ | MUC17 bispecific construct | IV | 0.25 | 0.1 | 12, 19, 26 |
| 5 | 10 | 5 × 10⁶ GSU-luc | 2 × 10⁷ CD3⁺ | MUC17 bispecific construct | IV | 0.025 | 0.1 | 12, 19, 26 |
|  | 55 |  |  | Additional animals (Residuals) to ensure equal tumor volume at treatment start |  |  |  |  |
| Σ | 100 |  |  | Animals at study start |  |  |  |  |

Sequence of the study:
Day 1: Subcutaneous injection of tumor cells (GSU-luc) into the right dorsal flank of female NOD/Scid mice (see above). The animals were 6 weeks of age at study start.
Day 7: Anti-asialo Treatment.
To deplete remaining NK cells/NK cell activity, mice were treated with a single dose of a polyclonal (rabbit anti-mouse) anti-asialo GM1 antibody. Anti-asialo GM1 antibody was reconstituted according to manufacturer's instruction and 50 µl of a 1:2.5 dilution with H₂O dest are injected IV into the lateral tail vein.
Day 8: Injection of CD3⁺ T cells into the peritoneal cavity of mice (see above).
Days 11, 18 and 25: FcR block.
The Fc-region of the test item was mutated to prevent binding to Fc☐-receptors. However, as NOD/Scid mice lack B cells, resulting in low immunoglobulin levels, a FcR-block was performed to avoid a potential reduction of CD3⁺ effector cells by antibody-dependent cell-mediated cytotoxicity. On day 11, 18 and 25, mice received a mixture of 2.4G2 anti-Fc☐R antibody (8 mg/kg) and Kiovig (400 mg/kg) by intraperitoneal bolus injection in a final volume of 200 µl per mouse per injection.
Days 12, 19 and 26: Treatment with test or control item (see Table 4).
Animals received test item (MUC17/CD3 bispecific antibody construct) or control item (vehicle) by intravenous (IV) bolus injection into the lateral tail vein on days 12, 19 and 26 according to Table 4. The dose volume was kept constant to a total of 100 µl per mouse, per injection.
The tested item was formulated in 10 mM L-Glutamic acid, 9% (w/v) Sucrose, 0.01% (w/v) PS80; pH 4.2 at a stock concentration of 1.04 mg/ml and diluted in vehicle (25 mM L-Lysine monohydrochloride, 0.002% (w/v) polysorbate 80 in 0.9% (w/v) sodium chloride pH 7.0) according to the most recently determined group mean body weight (BW). The dose concentration (c) was calculated using the formula:

$$c\left[\frac{\mu g}{\mu l}\right] = \frac{\text{dose}\left[\frac{\mu g}{kg}\right] \times \text{mean } BW \text{ [kg]}}{\text{dose volume } [\mu l]}$$

Figure 6:
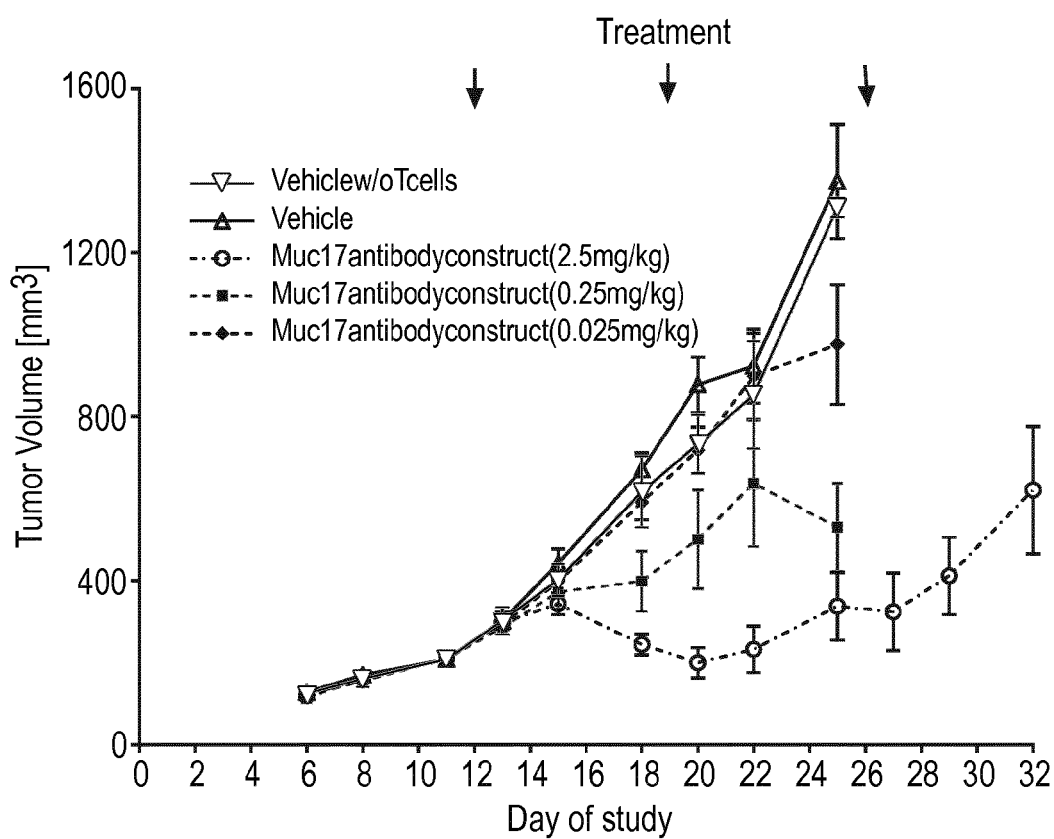
FIG. 6: MUC17-scFc antibody construct 8-B7 inhibits tumor growth in a xenograft model of colorectal cancer. Female NOD/SCID mice were implanted with $2 \times 10^6$ Ls174T colorectal cancer cells. On Day 15, $2 \times 10^7$ expanded, activated T cells were administered by intraperitoneal (IP) injection. The MUC17-scFc antibody construct was dosed IP on Day 16 and Day 22. Tumor size was measured with calipers.

Day 33: Study end
(Experimental Investigations and Calculations.
During the course of the study, all animals were observed daily for general appearance, activity, behavior and survival. All findings and remarks were noted in the appropriate sheet in the study file. Body weights were determined 3 times per week throughout the course of the study. The progress of tumor growth was determined by measurement of tumor height and width using external caliper. Tumor growth was determined 3 times per week and tumor volumes (TV) were calculated using me formula:

$$TV = \frac{\text{height} \times \text{width}^2}{2},$$

where width is defined as the smaller and height is defined as the larger of the two measurements.
All measured raw data were downloaded to a computer and imported automatically into VIVO Manager software for further data management. Values not calculated by the VIVO Calculations program were calculated using the MS Excel spread sheet program or GraphPad Prism for Windows.
Graphical results are represented in FIG. 6 as group mean values ±standard error of the mean. Data were analyzed by one-way-analysis of variance (ANOVA), and differences in experimental results for tumor growth were assessed by Dunnett's post-hoc test for comparison against control group 2.
The relative tumor volume (RTV) was calculated by dividing the group mean tumor volume on day n by the group mean tumor volume on the day before treatment start (day 11).
Tumor growth inhibition was quantified for day 20, the last day when all animals in the control group were alive according to the formula:

Tumor growth inhibition [%] =

$$100 - \left(\frac{\text{median tumor volume treatment group [mm3]}}{\text{median tumor volume control group [mm3]}} \times 100\right)$$

Results
Intravenous treatment of GSU-luc tumor-bearing mice with MUC17/CD3 bispecific antibody construct (test item, SEQ ID NO: 186) resulted in statistically significant and dose-dependent tumor growth inhibition when compared with vehicle-treated mice in the control group 2. Following treatment start on day 12, values of p<0.01 (at 0.25 mg/kg) or p<0.001 (at 2.5 mg/kg) were achieved on days 18 and 20. As the majority of animals (6/10) in the control group had to be terminated, no statistical analysis was performed after day 20. The tumor growth inhibition observed on day 20 was 24% (0.025 mg/kg), 58% (0.25 mg/kg) and 77% (2.5 mg/kg). The comparison of the relative tumor volumes (RTV) on day 20 shows, that while tumors growing in the vehicle-treated mice had on average 4.2 times larger volume relative to the day before treatment start, the RTV in the test item-treated groups were 3.4 (0.025 mg/kg), 2.4 (0.25 mg/kg) and 1.0 (2.5 mg/kg). Following treatment at 2.5 mg/kg, the RTV was <2.0 until day 29.

The comparison of the two vehicle-treated control groups revealed, that T cells had no impact on the growth of GSU-luc cells in the absence of test item. The test item was well tolerated and drug-related adverse events were neither expected nor observed, as the mouse is a non-relevant species.

In summary: Intravenous administration of bispecific antibody constructs according to the present invention (test item SEQ ID NO: 186) at 2.5 or 0.25 mg/kg resulted in a statistically significant and dose-dependent inhibition of growth of subcutaneous GSU-luc tumors in female NOD/Scid mice.

Example 4: Exploratory Toxicology Study in Cynomolgus Monkeys

A MUC17 HLE BiTE antibody construct (SEQ ID: 186, construct 8-B7) was evaluated in an exploratory toxicology study in cynomolgus monkeys. Three monkeys were administered either 100 μg/kg or 1000 μg/kg of MUC17 scFc bispecific antibody construct by intravenous injection on Day 1 and Day 8 of the study. The MUC17 scFc bispecific antibody construct (SEQ ID NO 186) was well tolerated at both doses with no associated clinical signs or changes in body weight. Transient increases in body temperature were recorded at 100 μg/kg and 1000 μg/kg. Some hallmarks of MUC17 scFc bispecific antibody construct activity (lymphocyte redistribution, increased neutrophils and monocytes, increased c-reactive protein, slight increases in cytokines) were observed in blood samples from the monkeys treated with MUC17 scFc bispecific antibody construct. Although immunohistochemistry confirmed MUC17 expression on the apical surface of small intestine sampled from monkeys evaluated in the present exploratory toxicology study, there were no histopathological changes in the tissues expressing MUC17.

Figure 8A:
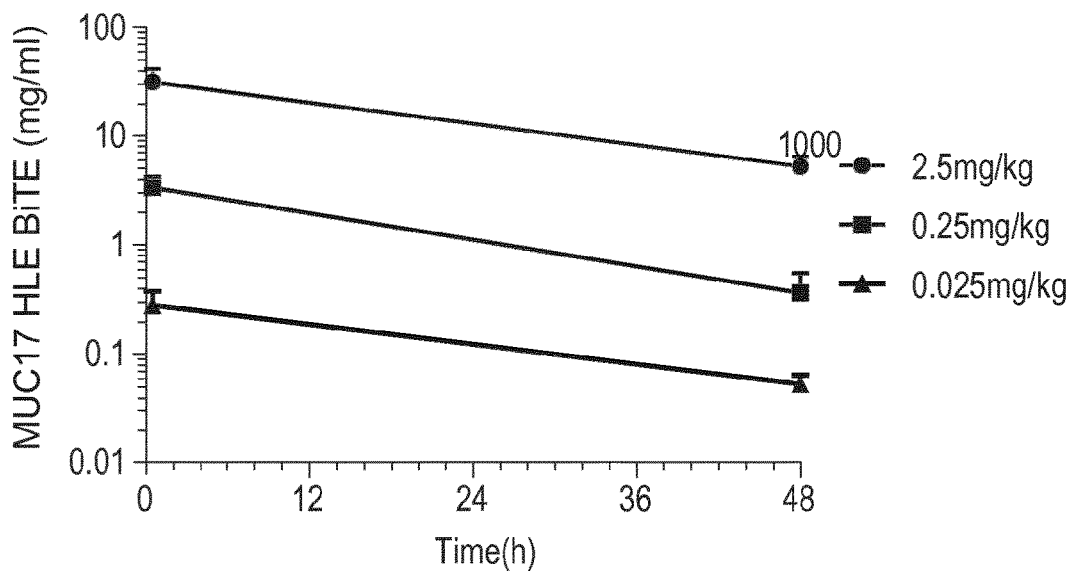
FIG. 8: The MUC17-scFc antibody construct 8-B7 has an extended half-life in cynomolgus monkey (A). Exposure levels are consistent with predicted exposures. (B) Cynomolgus monkeys (n=3 per group) were administered 100 mg/kg or 1000 mg/kg MUC17 HLE BiTE® at 0 h and 168 h. Serum was collected at the time points indicated and analyzed for the presence of MUC17 scFc bispecific antibody construct, using either an anti-CD3 antibody or an anti-MUC17 antibody based ELISA. The data were fit to a two-compartment model. The graph shows individual data (points) and the average value (line).
Figure 8B:
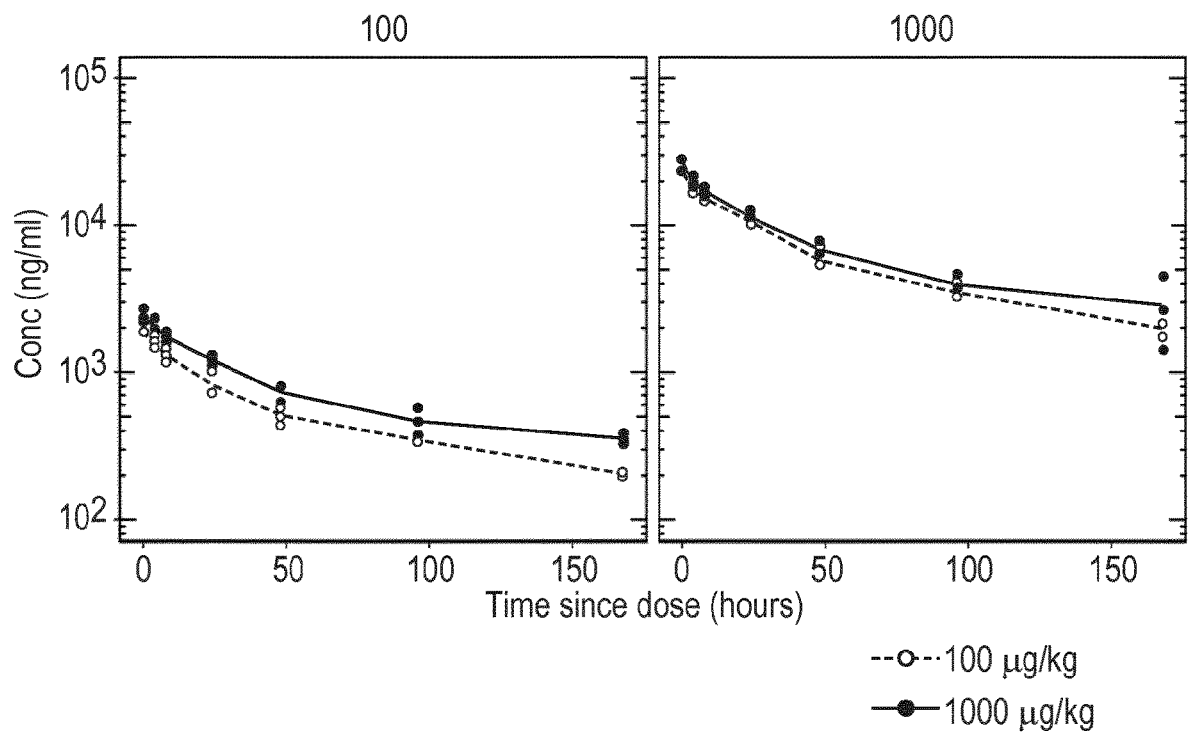

Toxicokinetic Parameters of MUC17 scFc Bispecific Antibody Construct in Cynomolgus Monkey The toxicokinetic parameters of the MUC17 scFc bispecific antibody construct (SEQ ID NO 186) were evaluated in blood samples taken from monkeys evaluated in the exploratory toxicology study. Blood samples were collected pre-dose and at 0.083, 4, 8, 24, 48, 96, and 168 hours after each dose. The serum concentration of the MUC17 scFc bispecific antibody construct was determined by immunoassay using a ruthenylated murine anti-human IgG Fc 1.35.1 mAb directed against MUC17 to capture the antibody construct and an antibody directed against the Fc moiety to detect the construct. Serum levels of the MUC17 scFc bispecific antibody construct were detected at all time points analyzed after first dose. The data were fitted to a two-compartment model. FIG. 8 (B) shows individual data (points) and the average value (line). Several pharmacokinetic parameters were assessed, including systemic clearance (CL), inter-compartmental clearance (Q), serum volume/volume of the central compartment (Vp), tissue volume/volume of the tissue compartment (Vt), terminal half-life (t½), and for the second dose 1000 mcg/kg dose the average maximal concentration ($C_{max}$) and area under the serum concentration-time ($AUC_{inf}$).

Example 5: T Cell Dependent Cytotoxicity Assays in Normal Intestinal Cells

To further test the idea that the localization of MUC17 to the apical surface of normal intestinal cells of human and cynomolgus monkey is inaccessible to the cytotoxic activity of the MUC17 scFc bispecific antibody construct (SEQ ID NO 186), MUC17 expression and MUC17 scFc bispecific antibody construct activity are evaluated in normal cells in vitro. MUC17 cell surface expression is assessed by fluorescence-activated cell sorting. Cytotoxic activity of the MUC17 scFc bispecific antibody construct is evaluated in T cell dependent cytotoxicity (TDCC) assays, where the MUC17 scFc bispecific antibody construct is incubated with MUC17-positive target cells and human or monkey effector cells (i.e. T cells or peripheral blood mononuclear cells) and then viability of the cells is assessed. These experiments are initially tested using standard two-dimensional cell culture. However, in order to better observe the localization of MUC17 to the apical surface, normal cells are cultured in a way that maintains epithelial cell polarity, such as growth on an extracellular matrix or in in organoid culture. MUC17 scFc bispecific antibody construct has shown no significantly increased TDCC with respect to normal, i.e. non-cancer intestinal cells.

TABLE 5

Sequence Table

| SEQ ID NO: | Designation | Source | | Sequence |
|---|---|---|---|---|
| 1. | G4S linker | artificial | aa | GGGGS |
| 2. | (G4S)2 linker | artificial | aa | GGGGSGGGGS |
| 3. | (G4S)3 linker | artificial | aa | GGGGSGGGGSGGGGS |
| 4. | (G4S)4 linker | artificial | aa | GGGGSGGGGSGGGGSGGGGS |
| 5. | (G4S)5 linker | artificial | aa | GGGGSGGGGSGGGGSGGGGSGGGGS |
| 6. | (G4S)6 linker | artificial | aa | GGGGSGGGGSGGGGSGGGGSGGGGSGGGGS |
| 7. | (G4S)7 linker | artificial | aa | GGGGSGGGGSGGGGSGGGGSGGGGSGGGGSGGGGS |

TABLE 5-continued

Sequence Table

| SEQ ID NO: | Designation | Source | Sequence |
|---|---|---|---|
| 8. | (G4S)8 linker | artificial aa | GGGGSGGGGSGGGGSGGGGSGGGGSGGGGSGGGGSGGGGS |
| 9. | Peptide linker | artificial aa | PGGGGS |
| 10. | Peptide linker | artificial aa | PGGDGS |
| 11. | Peptide linker | artificial aa | SGGGGS |
| 12. | Peptide linker | artificial aa | GGGG |
| 13. | CD3ε binder VL | artificial aa | QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 14. | CD3ε binder VH | artificial aa | EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSS |
| 15. | CD3ε binder scFv | artificial aa | EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 16. | hexa-histidine tag | artificial aa | HHHHHH |
| 17. | Fc monomer-1 +c/-g | artificial aa | DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 18. | Fc monomer-2 +c/-g/delGK | artificial aa | DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP |
| 19. | Fc monomer-3 -c/+g | artificial aa | DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 20. | Fc monomer-4 -c/+g/delGK | artificial aa | DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP |
| 21. | Fc monomer-5 -c/-g | artificial aa | DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 22. | Fc monomer-6 -c/-g/delGK | artificial aa | DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQV |

TABLE 5-continued

Sequence Table

| SEQ ID NO: | Designation | Source | Sequence |
|---|---|---|---|
| | | | SLTCLVKGFYPSDIAVEWESNGQPENNYKTTPPVLD SDGSFFLYSKLTVDKSRWQQGNVFSCSVMHEALHN HYTQKSLSLSP |
| 23. | Fc monomer-7 +c/+g | artificial aa | DKTHTCPPCPAPELLGGPSVFLFPPKPKDTLMISRTPE VTCVVVDVSHEDPEVKFNWYVDGVEVHNAKTKPC EEQYNSTYRCVSVLTVLHQDWLNGKEYKCKVSNK ALPAPIEKTISKAKGQPREPQVYTLPPSREEMTKNQV SLTCLVKGFYPSDIAVEWESNGQPENNYKTTPPVLD SDGSFFLYSKLTVDKSRWQQGNVFSCSVMHEALHN HYTQKSLSLSPGK |
| 24. | Fc monomer-8 +c/+g/delGK | artificial aa | DKTHTCPPCPAPELLGGPSVFLFPPKPKDTLMISRTPE VTCVVVDVSHEDPEVKFNWYVDGVEVHNAKTKPC EEQYNSTYRCVSVLTVLHQDWLNGKEYKCKVSNK ALPAPIEKTISKAKGQPREPQVYTLPPSREEMTKNQV SLTCLVKGFYPSDIAVEWESNGQPENNYKTTPPVLD SDGSFFLYSKLTVDKSRWQQGNVFSCSVMHEALHN HYTQKSLSLSP |
| 25. | scFc-1 | artificial aa | DKTHTCPPCPAPELLGGPSVFLFPPKPKDTLMISRTPE VTCVVVDVSHEDPEVKFNWYVDGVEVHNAKTKPC EEQYGSTYRCVSVLTVLHQDWLNGKEYKCKVSNK ALPAPIEKTISKAKGQPREPQVYTLPPSREEMTKNQV SLTCLVKGFYPSDIAVEWESNGQPENNYKTTPPVLD SDGSFFLYSKLTVDKSRWQQGNVFSCSVMHEALHN HYTQKSLSLSPGKGGGGSGGGGSGGGGSGGGGSGG GGSGGGGSDKTHTCPPCPAPELLGGPSVFLFPPKPKD TLMISRTPEVTCVVVDVSHEDPEVKFNWYVDGVEV HNAKTKPCEEQYGSTYRCVSVLTVLHQDWLNGKEY KCKVSNKALPAPIEKTISKAKGQPREPQVYTLPPSRE EMTKNQVSLTCLVKGFYPSDIAVEWESNGQPENNY KTTPPVLDSDGSFFLYSKLTVDKSRWQQGNVFSCSV MHEALHNHYTQKSLSLSPGK |
| 26. | scFc-2 | artificial aa | DKTHTCPPCPAPELLGGPSVFLFPPKPKDTLMISRTPE VTCVVVDVSHEDPEVKFNWYVDGVEVHNAKTKPC EEQYGSTYRCVSVLTVLHQDWLNGKEYKCKVSNK ALPAPIEKTISKAKGQPREPQVYTLPPSREEMTKNQV SLTCLVKGFYPSDIAVEWESNGQPENNYKTTPPVLD SDGSFFLYSKLTVDKSRWQQGNVFSCSVMHEALHN HYTQKSLSLSPGGGGSGGGGSGGGGSGGGGSGGGG SGGGGSDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSP |
| 27. | scFc-3 | artificial aa | DKTHTCPPCPAPELLGGPSVFLFPPKPKDTLMISRTPE VTCVVVDVSHEDPEVKFNWYVDGVEVHNAKTKPR EEQYNSTYRVVSVLTVLHQDWLNGKEYKCKVSNK ALPAPIEKTISKAKGQPREPQVYTLPPSREEMTKNQV SLTCLVKGFYPSDIAVEWESNGQPENNYKTTPPVLD SDGSFFLYSKLTVDKSRWQQGNVFSCSVMHEALHN HYTQKSLSLSPGKGGGGSGGGGSGGGGSGGGGSGG GGSGGGGSDKTHTCPPCPAPELLGGPSVFLFPPKPKD TLMISRTPEVTCVVVDVSHEDPEVKFNWYVDGVEV HNAKTKPREEQYNSTYRVVSVLTVLHQDWLNGKE YKCKVSNKALPAPIEKTISKAKGQPREPQVYTLPPSR EEMTKNQVSLTCLVKGFYPSDIAVEWESNGQPENN YKTTPPVLDSDGSFFLYSKLTVDKSRWQQGNVFSCS VMHEALHNHYTQKSLSLSPGK |
| 28. | scFc-4 | artificial aa | DKTHTCPPCPAPELLGGPSVFLFPPKPKDTLMISRTPE VTCVVVDVSHEDPEVKFNWYVDGVEVHNAKTKPR EEQYNSTYRVVSVLTVLHQDWLNGKEYKCKVSNK ALPAPIEKTISKAKGQPREPQVYTLPPSREEMTKNQV SLTCLVKGFYPSDIAVEWESNGQPENNYKTTPPVLD SDGSFFLYSKLTVDKSRWQQGNVFSCSVMHEALHN HYTQKSLSLSPGGGGSGGGGSGGGGSGGGGSGGGG SGGGGSDKTHTCPPCPAPELLGGPSVFLFPPKPKDTL MISRTPEVTCVVVDVSHEDPEVKFNWYVDGVEVHN AKTKPREEQYNSTYRVVSVLTVLHQDWLNGKEYKC |

TABLE 5-continued

Sequence Table

| SEQ ID NO: | Designation | Source | Sequence |
|---|---|---|---|
| | | | KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSP |
| 29. | scFc-5 | artificial aa | DKTHTCPPCPAPELLGGPSVFLFPPKPKDTLMISRTPE VTCVVVDVSHEDPEVKFNWYVDGVEVHNAKTKPR EEQYGSTYRVVSVLTVLHQDWLNGKEYKCKVSNK ALPAPIEKTISKAKGQPREPQVYTLPPSREEMTKNQV SLTCLVKGFYPSDIAVEWESNGQPENNYKTTPPVLD SDGSFFLYSKLTVDKSRWQQGNVFSCSVMHEALHN HYTQKSLSLSPGKGGGGSGGGGSGGGGSGGGGSGG GGSGGGGSDKTHTCPPCPAPELLGGPSVFLFPPKPKD TLMISRTPEVTCVVVDVSHEDPEVKFNWYVDGVEV HNAKTKPREEQYGSTYRVVSVLTVLHQDWLNGKE YKCKVSNKALPAPIEKTISKAKGQPREPQVYTLPPSR EEMTKNQVSLTCLVKGFYPSDIAVEWESNGQPENN YKTTPPVLDSDGSFFLYSKLTVDKSRWQQGNVFSCS VMHEALHNHYTQKSLSLSPGK |
| 30. | scFc-6 | artificial aa | DKTHTCPPCPAPELLGGPSVFLFPPKPKDTLMISRTPE VTCVVVDVSHEDPEVKFNWYVDGVEVHNAKTKPR EEQYGSTYRVVSVLTVLHQDWLNGKEYKCKVSNK ALPAPIEKTISKAKGQPREPQVYTLPPSREEMTKNQV SLTCLVKGFYPSDIAVEWESNGQPENNYKTTPPVLD SDGSFFLYSKLTVDKSRWQQGNVFSCSVMHEALHN HYTQKSLSLSPGGGGSGGGGSGGGGSGGGGSGGGG SGGGGSDKTHTCPPCPAPELLGGPSVFLFPPKPKDTL MISRTPEVTCVVVDVSHEDPEVKFNWYVDGVEVHN AKTKPREEQYGSTYRVVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSP |
| 31. | scFc-7 | artificial aa | DKTHTCPPCPAPELLGGPSVFLFPPKPKDTLMISRTPE VTCVVVDVSHEDPEVKFNWYVDGVEVHNAKTKPC EEQYNSTYRCVSVLTVLHQDWLNGKEYKCKVSNK ALPAPIEKTISKAKGQPREPQVYTLPPSREEMTKNQV SLTCLVKGFYPSDIAVEWESNGQPENNYKTTPPVLD SDGSFFLYSKLTVDKSRWQQGNVFSCSVMHEALHN HYTQKSLSLSPGKGGGGSGGGGSGGGGSGGGGSGG GGSGGGGSDKTHTCPPCPAPELLGGPSVFLFPPKPKD TLMISRTPEVTCVVVDVSHEDPEVKFNWYVDGVEV HNAKTKPCEEQYNSTYRCVSVLTVLHQDWLNGKEY KCKVSNKALPAPIEKTISKAKGQPREPQVYTLPPSRE EMTKNQVSLTCLVKGFYPSDIAVEWESNGQPENNY KTTPPVLDSDGSFFLYSKLTVDKSRWQQGNVFSCSV MHEALHNHYTQKSLSLSPGK |
| 32. | scFc-8 | artificial aa | DKTHTCPPCPAPELLGGPSVFLFPPKPKDTLMISRTPE VTCVVVDVSHEDPEVKFNWYVDGVEVHNAKTKPC EEQYNSTYRCVSVLTVLHQDWLNGKEYKCKVSNK ALPAPIEKTISKAKGQPREPQVYTLPPSREEMTKNQV SLTCLVKGFYPSDIAVEWESNGQPENNYKTTPPVLD SDGSFFLYSKLTVDKSRWQQGNVFSCSVMHEALHN HYTQKSLSLSPGGGGSGGGGSGGGGSGGGGSGGGG SGGGGSDKTHTCPPCPAPELLGGPSVFLFPPKPKDTL MISRTPEVTCVVVDVSHEDPEVKFNWYVDGVEVHN AKTKPCEEQYNSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSP |
| 33. | MU 92-G6 CC x I2C0-scFc VH CDR1 | artificial aa | SYGMH |
| 34. | MU 92-G6 CC x I2C0-scFc VH CDR2 | artificial aa | VISFEGSNKYYASSVKG |

TABLE 5-continued

Sequence Table

| SEQ ID NO: | Designation | Source | Sequence |
|---|---|---|---|
| 35. | MU 92-G6 CC x I2C0-scFc VH CDR3 | artificial aa | GAYTYGFDY |
| 36. | MU 92-G6 CC x I2C0-scFc VL CDR1 | artificial aa | RASQSVNRYLA |
| 37. | MU 92-G6 CC x I2C0-scFc VL CDR2 | artificial aa | GASNRAT |
| 38. | MU 92-G6 CC x I2C0-scFc VL CDR3 | artificial aa | HHYGSSIFA |
| 39. | MU 92-G6 CC x I2C0-scFc VH | artificial aa | QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSS |
| 40. | MU 92-G6 CC x I2C0-scFc VL | artificial aa | EIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK |
| 41. | MU 92-G6 CC x I2C0-scFc scFv | artificial aa | QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK |
| 42. | MU 92-G6 CC x I2C0-scFc Bispecific molecule | artificial aa | QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 43. | MU 92-G6 CC x I2C0-scFc Bispecific HLE molecule | artificial aa | QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQ |

TABLE 5-continued

Sequence Table

| SEQ ID NO: | Designation | Source | Sequence |
|---|---|---|---|
| | | | PENNYKTTPPVLDSDGSFFLYSKLTVDKSRWQQGN VFSCSVMHEALHNHYTQKSLSLSPGK |
| 44. | MU 92-C12 CC x I2C0-scFc VH CDR1 | artificial aa | SFGMH |
| 45. | MU 92-C12 CC x I2C0-scFc VH CDR2 | artificial aa | VIWFSGSNKYYAEAVKG |
| 46. | MU 92-C12 CC x I2C0-scFc VH CDR3 | artificial aa | GGYTYGFDY |
| 47. | MU 92-C12 CC x I2C0-scFc VL CDR1 | artificial aa | RANQAINRYLA |
| 48. | MU 92-C12 CC x I2C0-scFc VL CDR2 | artificial aa | GASSRAT |
| 49. | MU 92-C12 CC x I2C0-scFc VL CDR3 | artificial aa | HHYGSSIFT |
| 50. | MU 92-C12 CC x I2C0-scFc VH | artificial aa | QVQLVESGGGVVQPGRSLRLSCAASGFTFSSFGMH WVRQAPGKCLEWVAVIWFSGSNKYYAEAVKGRFTI SRDNSKNTLYLQMNNLRAEDTAVYYCARGGYTYG FDYWGQGTLVTVSS |
| 51. | MU 92-C12 CC x I2C0-scFc VL | artificial aa | EIVLTQSPATLSLSPGERATLSCRANQAINRYLAWYQ QKPGQAPRLLIYGASSRATGIPDRFSGSGSGTDFTLTI SRLEPEDFAVYYCHHYGSSIFTFGCGTKVEIK |
| 52. | MU 92-C12 CC x I2C0-scFc scFv | artificial aa | QVQLVESGGGVVQPGRSLRLSCAASGFTFSSFGMH WVRQAPGKCLEWVAVIWFSGSNKYYAEAVKGRFTI SRDNSKNTLYLQMNNLRAEDTAVYYCARGGYTYG FDYWGQGTLVTVSSGGGGSGGGGSGGGGSEIVLTQ SPATLSLSPGERATLSCRANQAINRYLAWYQQKPGQ APRLLIYGASSRATGIPDRFSGSGSGTDFTLTISRLEPE DFAVYYCHHYGSSIFTFGCGTKVEIK |
| 53. | MU 92-C12 CC x I2C0-scFc Bispecific molecule | artificial aa | QVQLVESGGGVVQPGRSLRLSCAASGFTFSSFGMH WVRQAPGKCLEWVAVIWFSGSNKYYAEAVKGRFTI SRDNSKNTLYLQMNNLRAEDTAVYYCARGGYTYG FDYWGQGTLVTVSSGGGGSGGGGSGGGGSEIVLTQ SPATLSLSPGERATLSCRANQAINRYLAWYQQKPGQ APRLLIYGASSRATGIPDRFSGSGSGTDFTLTISRLEPE DFAVYYCHHYGSSIFTFGCGTKVEIKSGGGGSEVQL VESGGGLVQPGGSLKLSCAASGFTFNKYAMNWVRQ APGKGLEWVARIRSKYNNYATYYADSVKDRFTISR DDSKNTAYLQMNNLKTEDTAVYYCVRHGNFGNSYI SYWAYWGQGTLVTVSSGGGGSGGGGSGGGGSQTV VTQEPSLTVSPGGTVTLTCGSSTGAVTSGNYPNWVQ QKPGQAPRGLIGGTKFLAPGTPARFSGSLLGGKAAL TLSGVQPEDEAEYYCVLWYSNRWVFGGGTKLTVL |
| 54. | MU 92-C12 CC x I2C0-scFc Bispecific HLE molecule | artificial aa | QVQLVESGGGVVQPGRSLRLSCAASGFTFSSFGMH WVRQAPGKCLEWVAVIWFSGSNKYYAEAVKGRFTI SRDNSKNTLYLQMNNLRAEDTAVYYCARGGYTYG FDYWGQGTLVTVSSGGGGSGGGGSGGGGSEIVLTQ SPATLSLSPGERATLSCRANQAINRYLAWYQQKPGQ APRLLIYGASSRATGIPDRFSGSGSGTDFTLTISRLEPE DFAVYYCHHYGSSIFTFGCGTKVEIKSGGGGSEVQL VESGGGLVQPGGSLKLSCAASGFTFNKYAMNWVRQ APGKGLEWVARIRSKYNNYATYYADSVKDRFTISR DDSKNTAYLQMNNLKTEDTAVYYCVRHGNFGNSYI SYWAYWGQGTLVTVSSGGGGSGGGGSGGGGSQTV VTQEPSLTVSPGGTVTLTCGSSTGAVTSGNYPNWVQ QKPGQAPRGLIGGTKFLAPGTPARFSGSLLGGKAAL TLSGVQPEDEAEYYCVLWYSNRWVFGGGTKLTVLG GGGDKTHTCPPCPAPELLGGPSVFLFPPKPKDTLMIS RTPEVTCVVVDVSHEDPEVKFNWYVDGVEVHNAK |

TABLE 5-continued

Sequence Table

| SEQ ID NO: | Designation | Source | Sequence |
|---|---|---|---|
| | | | TKPCEEQYGSTYRCVSVLTVLHQDWLNGKEYKCKV SNKALPAPIEKTISKAKGQPREPQVYTLPPSREEMTK NQVSLTCLVKGFYPSDIAVEWESNGQPENNYKTTPP VLDSDGSFFLYSKLTVDKSRWQQGNVFSCSVMHEA LHNHYTQKSLSLSPGKGGGGSGGGGSGGGGSGGGG SGGGGSGGGGSDKTHTCPPCPAPELLGGPSVFLFPPK PKDTLMISRTPEVTCVVVDVSHEDPEVKFNWYVDG VEVHNAKTKPCEEQYGSTYRCVSVLTVLHQDWLNG KEYKCKVSNKALPAPIEKTISKAKGQPREPQVYTLPP SREEMTKNQVSLTCLVKGFYPSDIAVEWESNGQPEN NYKTTPPVLDSDGSFFLYSKLTVDKSRWQQGNVFSC SVMHEALHNHYTQKSLSLSPGK |
| 55. | MU 32-G6 CC x I2C0-scFc VH CDR1 | artificial aa | NHAMH |
| 56. | MU 32-G6 CC x I2C0-scFc VH CDR2 | artificial aa | GIWSEGSNKYYAESVKG |
| 57. | MU 32-G6 CC x I2C0-scFc VH CDR3 | artificial aa | ATYTTGWSYFDY |
| 58. | MU 32-G6 CC x I2C0-scFc VL CDR1 | artificial aa | SGDKLGDKYAS |
| 59. | MU 32-G6 CC x I2C0-scFc VL CDR2 | artificial aa | QDRKRPS |
| 60. | MU 32-G6 CC x I2C0-scFc VL CDR3 | artificial aa | QAYDASTWV |
| 61. | MU 32-G6 CC x I2C0-scFc VH | artificial aa | QVQLVESGGGVVQPGRSLRLSCAASGFTFSNHAMH WVRQAPGKCLEWVAGIWSEGSNKYYAESVKGRFTI SRDNSKNTLYLQMNSLRAEDTAVYYCARATYTTG WSYFDYWGQGTLVTVSS |
| 62. | MU 32-G6 CC x I2C0-scFc VL | artificial aa | SYELTQPPSVSVSPGQTASITCSGDKLGDKYASWYQ QKSGQSPVLVIYQDRKRPSGIPERFSGSNSGNTATLTI SGTQAMDEADYYCQAYDASTWVFGCGTQLTVL |
| 63. | MU 32-G6 CC x I2C0-scFc scFv | artificial aa | QVQLVESGGGVVQPGRSLRLSCAASGFTFSNHAMH WVRQAPGKCLEWVAGIWSEGSNKYYAESVKGRFTI SRDNSKNTLYLQMNSLRAEDTAVYYCARATYTTG WSYFDYWGQGTLVTVSSGGGGSGGGGSGGGGSSY ELTQPPSVSVSPGQTASITCSGDKLGDKYASWYQQK SGQSPVLVIYQDRKRPSGIPERFSGSNSGNTATLTISG TQAMDEADYYCQAYDASTWVFGCGTQLTVL |
| 64. | MU 32-G6 CC x I2C0-scFc Bispecific molecule | artificial aa | QVQLVESGGGVVQPGRSLRLSCAASGFTFSNHAMH WVRQAPGKCLEWVAGIWSEGSNKYYAESVKGRFTI SRDNSKNTLYLQMNSLRAEDTAVYYCARATYTTG WSYFDYWGQGTLVTVSSGGGGSGGGGSGGGGSSY ELTQPPSVSVSPGQTASITCSGDKLGDKYASWYQQK SGQSPVLVIYQDRKRPSGIPERFSGSNSGNTATLTISG TQAMDEADYYCQAYDASTWVFGCGTQLTVLSGGG GSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVL |
| 65. | MU 32-G6 CC x I2C0-scFc Bispecific HLE molecule | artificial aa | QVQLVESGGGVVQPGRSLRLSCAASGFTFSNHAMH WVRQAPGKCLEWVAGIWSEGSNKYYAESVKGRFTI SRDNSKNTLYLQMNSLRAEDTAVYYCARATYTTG WSYFDYWGQGTLVTVSSGGGGSGGGGSGGGGSSY ELTQPPSVSVSPGQTASITCSGDKLGDKYASWYQQK |

TABLE 5-continued

Sequence Table

| SEQ ID NO: | Designation | Source | Sequence |
|---|---|---|---|
| | | | SGQSPVLVIYQDKRPSGIPERFSGSNSGNTATLTISG<br>TQAMDEADYYCQAYDASTWVFGCGTQLTVLSGGG<br>GSEVQLVESGGGLVQPGGSLKLSCAASGFTFNKYA<br>MNWVRQAPGKGLEWVARIRSKYNNYATYYADSVK<br>DRFTISRDDSKNTAYLQMNNLKTEDTAVYYCVRHG<br>NFGNSYISYWAYWGQGTLVTVSSGGGGSGGGGSGG<br>GGSQTVVTQEPSLTVSPGGTVTLTCGSSTGAVTSGN<br>YPNWVQQKPGQAPRGLIGGTKFLAPGTPARFSGSLL<br>GGKAALTLSGVQPEDEAEYYCVLWYSNRWVFGGG<br>TKLTVLGGGGDKTHTCPPCPAPELLGGPSVFLFPPKP<br>KDTLMISRTPEVTCVVVDVSHEDPEVKFNWYVDGV<br>EVHNAKTKPCEEQYGSTYRCVSVLTVLHQDWLNGK<br>EYKCKVSNKALPAPIEKTISKAKGQPREPQVYTLPPS<br>REEMTKNQVSLTCLVKGFYPSDIAVEWESNGQPEN<br>NYKTTPPVLDSDGSFFLYSKLTVDKSRWQQGNVFSC<br>SVMHEALHNHYTQKSLSLSPGKGGGGSGGGGSGGG<br>GSGGGGSGGGGSGGGGSDKTHTCPPCPAPELLGGPS<br>VFLFPPKPKDTLMISRTPEVTCVVVDVSHEDPEVKFN<br>WYVDGVEVHNAKTKPCEEQYGSTYRCVSVLTVLH<br>QDWLNGKEYKCKVSNKALPAPIEKTISKAKGQPREP<br>QVYTLPPSREEMTKNQVSLTCLVKGFYPSDIAVEWE<br>SNGQPENNYKTTPPVLDSDGSFFLYSKLTVDKSRWQ<br>QGNVFSCSVMHEALHNHYTQKSLSLSPGK |
| 66. | MU 9-C2 CC x I2C0-scFc VH CDR1 | artificial aa | NFGMH |
| 67. | MU 9-C2 CC x I2C0-scFc VH CDR2 | artificial aa | VIWFDASKTYYASSVKG |
| 68. | MU 9-C2 CC x I2C0-scFc VH CDR3 | artificial aa | ATYSTGWSYFDY |
| 69. | MU 9-C2 CC x I2C0-scFc VL CDR1 | artificial aa | SGDKLGDKYTS |
| 70. | MU 9-C2 CC x I2C0-scFc VL CDR2 | artificial aa | HDAKRPS |
| 71. | MU 9-C2 CC x I2C0-scFc VL CDR3 | artificial aa | QAWDASTAWV |
| 72. | MU 9-C2 CC x I2C0-scFc VH | artificial aa | QVQLVESGGGVVQPGRSLRLSCAASGFTFSNFGMH<br>WVRQAPGKCLEWVAVIWFDASKTYYASSVKGRFTI<br>SRDTSMNTLYLQMNSLRAEDTAVYYCARATYSTG<br>WSYFDYWGQGTLVTVSS |
| 73. | MU 9-C2 CC x I2C0-scFc VL | artificial aa | SYELTQPPSVSVSPGQTASITCSGDKLGDKYTSWYQ<br>QKPGQSPVLVIYHDAKRPSGIPERFSGSNSGNTATLTI<br>SGTQAMDEADYYCQAWDASTAWVFGCGTKLTVL |
| 74. | MU 9-C2 CC x I2C0-scFc scFv | artificial aa | QVQLVESGGGVVQPGRSLRLSCAASGFTFSNFGMH<br>WVRQAPGKCLEWVAVIWFDASKTYYASSVKGRFTI<br>SRDTSMNTLYLQMNSLRAEDTAVYYCARATYSTG<br>WSYFDYWGQGTLVTVSSGGGGSGGGGSGGGGSSY<br>ELTQPPSVSVSPGQTASITCSGDKLGDKYTSWYQQK<br>PGQSPVLVIYHDAKRPSGIPERFSGSNSGNTATLTISG<br>TQAMDEADYYCQAWDASTAWVFGCGTKLTVL |
| 75. | MU 9-C2 CC x I2C0-scFc Bispecific molecule | artificial aa | QVQLVESGGGVVQPGRSLRLSCAASGFTFSNFGMH<br>WVRQAPGKCLEWVAVIWFDASKTYYASSVKGRFTI<br>SRDTSMNTLYLQMNSLRAEDTAVYYCARATYSTG<br>WSYFDYWGQGTLVTVSSGGGGSGGGGSGGGGSSY<br>ELTQPPSVSVSPGQTASITCSGDKLGDKYTSWYQQK<br>PGQSPVLVIYHDAKRPSGIPERFSGSNSGNTATLTISG<br>TQAMDEADYYCQAWDASTAWVFGCGTKLTVLSGG<br>GGSEVQLVESGGGLVQPGGSLKLSCAASGFTFNKYA<br>MNWVRQAPGKGLEWVARIRSKYNNYATYYADSVK<br>DRFTISRDDSKNTAYLQMNNLKTEDTAVYYCVRHG |

TABLE 5-continued

Sequence Table

| SEQ ID NO: | Designation | Source | Sequence |
|---|---|---|---|
| | | | NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVL |
| 76. | MU 9-C2 CC x I2C0-scFc Bispecific HLE molecule | artificial aa | QVQLVESGGGVVQPGRSLRLSCAASGFTFSNFGMH WVRQAPGKCLEWVAVIWFDASKTYYASSVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWDASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGGGSDKTHTCPPCPAPELLGGPS VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |
| 77. | MU 8-H9 CC x I2C0-scFc VH CDR1 | artificial aa | GYYWS |
| 78. | MU 8-H9 CC x I2C0-scFc VH CDR2 | artificial aa | DIEHSGSTKYNPSLKS |
| 79. | MU 8-H9 CC x I2C0-scFc VH CDR3 | artificial aa | KKYSTVWSYFDY |
| 80. | MU 8-H9 CC x I2C0-scFc VL CDR1 | artificial aa | SGDKLGDKYAS |
| 81. | MU 8-H9 CC x I2C0-scFc VL CDR2 | artificial aa | HDNKRPS |
| 82. | MU 8-H9 CC x I2C0-scFc VL CDR3 | artificial aa | QAYGSSSAV |
| 83. | MU 8-H9 CC x I2C0-scFc VH | artificial aa | QVQLQQWGAGLLKPSETLSLTCAVYGGSFSGYYWS WIRQPPGKCLEWIGDIEHSGSTKYNPSLKSRVTISLD TSKNQFSLKLNSVTAADTAVYFCARKKYSTVWSYF DYWGQGTLVTVSS |
| 84. | MU 8-H9 CC x I2C0-scFc VL | artificial aa | SYELTQSPSASVSPGQTASITCSGDKLGDKYASWYQ QKPGQSPVLVIYHDNKRPSGIPERFSGSNSGNTATLTI SGTQAMDEADYYCQAYGSSSAVFGCGTKLTVL |
| 85. | MU 8-H9 CC x I2C0-scFc scFv | artificial aa | QVQLQQWGAGLLKPSETLSLTCAVYGGSFSGYYWS WIRQPPGKCLEWIGDIEHSGSTKYNPSLKSRVTISLD TSKNQFSLKLNSVTAADTAVYFCARKKYSTVWSYF DYWGQGTLVTVSSGGGGSGGGGSGGGGSSYELTQS PSASVSPGQTASITCSGDKLGDKYASWYQQKPGQSP VLVIYHDNKRPSGIPERFSGSNSGNTATLTISGTQAM DEADYYCQAYGSSSAVFGCGTKLTVL |

TABLE 5-continued

Sequence Table

| SEQ ID NO: | Designation | Source | Sequence |
|---|---|---|---|
| 86. | MU 8-H9 CC x I2C0-scFc Bispecific molecule | artificial aa | QVQLQQWGAGLLKPSETLSLTCAVYGGSFSGYYWS WIRQPPGKCLEWIGDIEHSGSTKYNPSLKSRVTISLD TSKNQFSLKLNSVTAADTAVYFCARKKYSTVWSYF DYWGQGTLVTVSSGGGGSGGGGSGGGGSSYELTQS PSASVSPGQTASITCSGDKLGDKYASWYQQKPGQSP VLVIYHDNKRPSGIPERFSGSNSGNTATLTISGTQAM DEADYYCQAYGSSSAVFGCGTKLTVLSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 87. | MU 8-H9 CC x I2C0-scFc Bispecific HLE molecule | artificial aa | QVQLQQWGAGLLKPSETLSLTCAVYGGSFSGYYWS WIRQPPGKCLEWIGDIEHSGSTKYNPSLKSRVTISLD TSKNQFSLKLNSVTAADTAVYFCARKKYSTVWSYF DYWGQGTLVTVSSGGGGSGGGGSGGGGSSYELTQS PSASVSPGQTASITCSGDKLGDKYASWYQQKPGQSP VLVIYHDNKRPSGIPERFSGSNSGNTATLTISGTQAM DEADYYCQAYGSSSAVFGCGTKLTVLSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 88. | MU 8-H8 CC x I2C0-scFc VH CDR1 | artificial aa | GYYWS |
| 89. | MU 8-H8 CC x I2C0-scFc VH CDR2 | artificial aa | DIDASGSTKYNPSLKS |
| 90. | MU 8-H8 CC x I2C0-scFc VH CDR3 | artificial aa | KKYSTVWSYFDY |
| 91. | MU 8-H8 CC x I2C0-scFc VL CDR1 | artificial aa | SGDKLGDKYAS |
| 92. | MU 8-H8 CC x I2C0-scFc VL CDR2 | artificial aa | QDRKRPS |
| 93. | MU 8-H8 CC x I2C0-scFc VL CDR3 | artificial aa | QAWGSSTAV |
| 94. | MU 8-H8 CC x I2C0-scFc VH | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWGQGTLVTVSS |

TABLE 5-continued

Sequence Table

| SEQ ID NO: | Designation | Source | Sequence |
|---|---|---|---|
| 95. | MU 8-H8 CC x I2C0-scFc VL | artificial aa | SYELTQPPSVSVPPGQTASITCSGDKLGDKYASWYQ QKPGQSPVLIIYQDRKRPSGVPERFSGSNSGNTATLTI SGTQAMDEADYYCQAWGSSTAVFGCGTKLTVL |
| 96. | MU 8-H8 CC x I2C0-scFc scFv | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWGQGTLVTVSSGGGGSGGGGSGGGGSSYELTQP PSVSVPPGQTASITCSGDKLGDKYASWYQQKPGQSP VLIIYQDRKRPSGVPERFSGSNSGNTATLTISGTQAM DEADYYCQAWGSSTAVFGCGTKLTVL |
| 97. | MU 8-H8 CC x I2C0-scFc Bispecific molecule | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWGQGTLVTVSSGGGGSGGGGSGGGGSSYELTQP PSVSVPPGQTASITCSGDKLGDKYASWYQQKPGQSP VLIIYQDRKRPSGVPERFSGSNSGNTATLTISGTQAM DEADYYCQAWGSSTAVFGCGTKLTVLSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 98. | MU 8-H8 CC x I2C0-scFc Bispecific HLE molecule | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWGQGTLVTVSSGGGGSGGGGSGGGGSSYELTQP PSVSVPPGQTASITCSGDKLGDKYASWYQQKPGQSP VLIIYQDRKRPSGVPERFSGSNSGNTATLTISGTQAM DEADYYCQAWGSSTAVFGCGTKLTVLSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 99. | MU 8-H5 CC x I2C0-scFc VH CDR1 | artificial aa | SFGMH |
| 100. | MU 8-H5 CC x I2C0-scFc VH CDR2 | artificial aa | VIWFDASNKYYAESVKG |
| 101. | MU 8-H5 CC x I2C0-scFc VH CDR3 | artificial aa | GGYTYGFDY |
| 102. | MU 8-H5 CC x I2C0-scFc VL CDR1 | artificial aa | RASQAVNRYLA |

TABLE 5-continued

Sequence Table

| SEQ ID NO: | Designation | Source | Sequence |
|---|---|---|---|
| 103. | MU 8-H5 CC x I2C0-scFc VL CDR2 | artificial aa | GASSRAT |
| 104. | MU 8-H5 CC x I2C0-scFc VL CDR3 | artificial aa | QQYGSSIFT |
| 105. | MU 8-H5 CC x I2C0-scFc VH | artificial aa | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSS |
| 106. | MU 8-H5 CC x I2C0-scFc VL | artificial aa | EIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIK |
| 107. | MU 8-H5 CC x I2C0-scFc scFv | artificial aa | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIK |
| 108. | MU 8-H5 CC x I2C0-scFc Bispecific molecule | artificial aa | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 109. | MU 8-H5 CC x I2C0-scFc Bispecific HLE molecule | artificial aa | QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 110. | MU 8-F11 CC x I2C0-scFc VH CDR1 | artificial aa | SHYWS |

TABLE 5-continued

Sequence Table

| SEQ ID NO: | Designation | Source | Sequence |
|---|---|---|---|
| 111. | MU 8-F11 CC x I2C0-scFc VH CDR2 | artificial aa | RIDVSGSANYNPALKS |
| 112. | MU 8-F11 CC x I2C0-scFc VH CDR3 | artificial aa | APYSSGWGYFDY |
| 113. | MU 8-F11 CC x I2C0-scFc VL CDR1 | artificial aa | SGDKLGDKYAS |
| 114. | MU 8-F11 CC x I2C0-scFc VL CDR2 | artificial aa | HDNKRPS |
| 115. | MU 8-F11 CC x I2C0-scFc VL CDR3 | artificial aa | QAWDITTAV |
| 116. | MU 8-F11 CC x I2C0-scFc VH | artificial aa | QVQLQESGPGLVKPSETLSLTCTVSGGSISSHYWSWI RQSAGKCLEWIGRIDVSGSANYNPALKSRATMSADT SKNQFSLRLSSVTAADTAVYYCARAPYSSGWGYFD YWGQGTLVTVSS |
| 117. | MU 8-F11 CC x I2C0-scFc VL | artificial aa | SYELTQPPSVSVSPGQTASITCSGDKLGDKYASWYQ QQPGQSPVLVIYHDNKRPSGIPERFSGSNSGNTATLTI SGTQAMDEADYFCQAWDITTAVFGCGTKLTVL |
| 118. | MU 8-F11 CC x I2C0-scFc scFv | artificial aa | QVQLQESGPGLVKPSETLSLTCTVSGGSISSHYWSWI RQSAGKCLEWIGRIDVSGSANYNPALKSRATMSADT SKNQFSLRLSSVTAADTAVYYCARAPYSSGWGYFD YWGQGTLVTVSSGGGGSGGGGSGGGGSSYELTQPP SVSVSPGQTASITCSGDKLGDKYASWYQQQPGQSPV LVIYHDNKRPSGIPERFSGSNSGNTATLTISGTQAMD EADYFCQAWDITTAVFGCGTKLTVL |
| 119. | MU 8-F11 CC x I2C0-scFc Bispecific molecule | artificial aa | QVQLQESGPGLVKPSETLSLTCTVSGGSISSHYWSWI RQSAGKCLEWIGRIDVSGSANYNPALKSRATMSADT SKNQFSLRLSSVTAADTAVYYCARAPYSSGWGYFD YWGQGTLVTVSSGGGGSGGGGSGGGGSSYELTQPP SVSVSPGQTASITCSGDKLGDKYASWYQQQPGQSPV LVIYHDNKRPSGIPERFSGSNSGNTATLTISGTQAMD EADYFCQAWDITTAVFGCGTKLTVLSGGGGSEVQL VESGGGLVQPGGSLKLSCAASGFTFNKYAMNWVRQ APGKGLEWVARIRSKYNNYATYYADSVKDRFTISR DDSKNTAYLQMNNLKTEDTAVYYCVRHGNFGNSYI SYWAYWGQGTLVTVSSGGGGSGGGGSGGGGSQTV VTQEPSLTVSPGGTVTLTCGSSTGAVTSGNYPNWVQ QKPGQAPRGLIGGTKFLAPGTPARFSGSLLGGKAAL TLSGVQPEDEAEYYCVLWYSNRWVFGGGTKLTVL |
| 120. | MU 8-F11 CC x I2C0-scFc Bispecific HLE molecule | artificial aa | QVQLQESGPGLVKPSETLSLTCTVSGGSISSHYWSWI RQSAGKCLEWIGRIDVSGSANYNPALKSRATMSADT SKNQFSLRLSSVTAADTAVYYCARAPYSSGWGYFD YWGQGTLVTVSSGGGGSGGGGSGGGGSSYELTQPP SVSVSPGQTASITCSGDKLGDKYASWYQQQPGQSPV LVIYHDNKRPSGIPERFSGSNSGNTATLTISGTQAMD EADYFCQAWDITTAVFGCGTKLTVLSGGGGSEVQL VESGGGLVQPGGSLKLSCAASGFTFNKYAMNWVRQ APGKGLEWVARIRSKYNNYATYYADSVKDRFTISR DDSKNTAYLQMNNLKTEDTAVYYCVRHGNFGNSYI SYWAYWGQGTLVTVSSGGGGSGGGGSGGGGSQTV VTQEPSLTVSPGGTVTLTCGSSTGAVTSGNYPNWVQ QKPGQAPRGLIGGTKFLAPGTPARFSGSLLGGKAAL TLSGVQPEDEAEYYCVLWYSNRWVFGGGTKLTVLG GGGDKTHTCPPCPAPELLGGPSVFLFPPKPKDTLMIS RTPEVTCVVVDVSHEDPEVKFNWYVDGVEVHNAK TKPCEEQYGSTYRCVSVLTVLHQDWLNGKEYKCKV SNKALPAPIEKTISKAKGQPREPQVYTLPPSREEMTK NQVSLTCLVKGFYPSDIAVEWESNGQPENNYKTTPP VLDSDGSFFLYSKLTVDKSRWQQGNVFSCSVMHEA LHNHYTQKSLSLSPGKGGGGSGGGGSGGGGSGGGG SGGGGSGGGGSDKTHTCPPCPAPELLGGPSVFLFPPK PKDTLMISRTPEVTCVVVDVSHEDPEVKFNWYVDG |

TABLE 5-continued

Sequence Table

| SEQ ID NO: | Designation | Source | Sequence |
|---|---|---|---|
| | | | VEVHNAKTKPCEEQYGSTYRCVSVLTVLHQDWLNG KEYKCKVSNKALPAPIEKTISKAKGQPREPQVYTLPP SREEMTKNQVSLTCLVKGFYPSDIAVEWESNGQPEN NYKTTPPVLDSDGSFFLYSKLTVDKSRWQQGNVFSC SVMHEALHNHYTQKSLSLSPGK |
| 121. | MU 8-F9 CC x I2C0-scFc VH CDR1 | artificial aa | GYYWS |
| 122. | MU 8-F9 CC x I2C0-scFc VH CDR2 | artificial aa | DIDASGSTKYNPSLKS |
| 123. | MU 8-F9 CC x I2C0-scFc VH CDR3 | artificial aa | KKYSTVWSYFDY |
| 124. | MU 8-F9 CC x I2C0-scFc VL CDR1 | artificial aa | SGDKLGDKYAS |
| 125. | MU 8-F9 CC x I2C0-scFc VL CDR2 | artificial aa | QDRKRPS |
| 126. | MU 8-F9 CC x I2C0-scFc VL CDR3 | artificial aa | QAWGSSAAV |
| 127. | MU 8-F9 CC x I2C0-scFc VH | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWGQGTLVTVSS |
| 128. | MU 8-F9 CC x I2C0-scFc VL | artificial aa | SYELTQPSSVSVSPGQTASITCSGDKLGDKYASWYQ QKPGQSPVLVIYQDRKRPSGVPERFSGSNSGNTATLT ISGTQAMDEADYYCQAWGSSAAVFGCGTKLTVL |
| 129. | MU 8-F9 CC x I2C0-scFc scFv | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWGQGTLVTVSSGGGGSGGGGSGGGGSSYELTQP SSVSVSPGQTASITCSGDKLGDKYASWYQQKPGQSP VLVIYQDRKRPSGVPERFSGSNSGNTATLTISGTQAM DEADYYCQAWGSSAAVFGCGTKLTVL |
| 130. | MU 8-F9 CC x I2C0-scFc Bispecific molecule | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWGQGTLVTVSSGGGGSGGGGSGGGGSSYELTQP SSVSVSPGQTASITCSGDKLGDKYASWYQQKPGQSP VLVIYQDRKRPSGVPERFSGSNSGNTATLTISGTQAM DEADYYCQAWGSSAAVFGCGTKLTVLSGGGGSEV QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 131. | MU 8-F9 CC x I2C0-scFc Bispecific HLE molecule | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWGQGTLVTVSSGGGGSGGGGSGGGGSSYELTQP SSVSVSPGQTASITCSGDKLGDKYASWYQQKPGQSP VLVIYQDRKRPSGVPERFSGSNSGNTATLTISGTQAM DEADYYCQAWGSSAAVFGCGTKLTVLSGGGGSEV QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW |

TABLE 5-continued

Sequence Table

| SEQ ID NO: | Designation | Source | Sequence |
|---|---|---|---|
| | | | VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 132. | MU 8-E3 CC X I2C0-scFc VH CDR1 | artificial aa | NHGMH |
| 133. | MU 8-E3 CC X I2C0-scFc VH CDR2 | artificial aa | GIWSDASNKYYADAVKG |
| 134. | MU 8-E3 CC X I2C0-scFc VH CDR3 | artificial aa | ATYTTGWSYFDY |
| 135. | MU 8-E3 CC X I2C0-scFc VL CDR1 | artificial aa | SGDKLGDKYAS |
| 136. | MU 8-E3 CC X I2C0-scFc VL CDR2 | artificial aa | QDNKRPS |
| 137. | MU 8-E3 CC X I2C0-scFc VL CDR3 | artificial aa | QAYDASTWV |
| 138. | MU 8-E3 CC X I2C0-scFc VH | artificial aa | QVQLVESGGGVVQPGRSLRLACAASGFTFSNHGMH WVRQAPGKCLEWVAGIWSDASNKYYADAVKGRFT ISRDNSKNTLYLQMNSLRAEDTAVYYCARATYTTG WSYFDYWGQGTLVTVSS |
| 139. | MU 8-E3 CC X I2C0-scFc VL | artificial aa | SYELTQPASVSVSPGQTASITCSGDKLGDKYASWYQ QKSGQSPVLVIYQDNKRPSGIPERFSGSNSGNTATLTI SGTQAMDEADYYCQAYDASTWVFGCGTQLTVL |
| 140. | MU 8-E3 CC X I2C0-scFc scFv | artificial aa | QVQLVESGGGVVQPGRSLRLACAASGFTFSNHGMH WVRQAPGKCLEWVAGIWSDASNKYYADAVKGRFT ISRDNSKNTLYLQMNSLRAEDTAVYYCARATYTTG WSYFDYWGQGTLVTVSSGGGGSGGGGSGGGGSSY ELTQPASVSVSPGQTASITCSGDKLGDKYASWYQQK SGQSPVLVIYQDNKRPSGIPERFSGSNSGNTATLTISG TQAMDEADYYCQAYDASTWVFGCGTQLTVL |
| 141. | MU 8-E3 CC X I2C0-scFc Bispecific molecule | artificial aa | QVQLVESGGGVVQPGRSLRLACAASGFTFSNHGMH WVRQAPGKCLEWVAGIWSDASNKYYADAVKGRFT ISRDNSKNTLYLQMNSLRAEDTAVYYCARATYTTG WSYFDYWGQGTLVTVSSGGGGSGGGGSGGGGSSY ELTQPASVSVSPGQTASITCSGDKLGDKYASWYQQK SGQSPVLVIYQDNKRPSGIPERFSGSNSGNTATLTISG TQAMDEADYYCQAYDASTWVFGCGTQLTVLSGGG GSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVL |

TABLE 5-continued

Sequence Table

| SEQ ID NO: | Designation | Source | Sequence |
|---|---|---|---|
| 142. | MU 8-E3 CC X I2C0-scFc Bispecific HLE molecule | artificial aa | QVQLVESGGGVVQPGRSLRLACAASGFTFSNHGMH WVRQAPGKCLEWVAGIWSDASNKYYADAVKGRFT ISRDNSKNTLYLQMNSLRAEDTAVYYCARATYTTG WSYFDYWGQGTLVTVSSGGGGSGGGGSGGGGSSY ELTQPASVSVSPGQTASITCSGDKLGDKYASWYQQK SGQSPVLVIYQDNKRPSGIPERFSGSNSGNTATLTISG TQAMDEADYYCQAYDASTWVFGCGTQLTVLSGGG GSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGGGSDKTHTCPPCPAPELLGGPS VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |
| 143. | MU 8-D7 CC x I2C0-scFc VH CDR1 | artificial aa | GYYWS |
| 144. | MU 8-D7 CC x I2C0-scFc VH CDR2 | artificial aa | DIDASGSTKYNPSLKS |
| 145. | MU 8-D7 CC x I2C0-scFc VH CDR3 | artificial aa | KKYSTVWSYFDY |
| 146. | MU 8-D7 CC x I2C0-scFc VL CDR1 | artificial aa | SGDKLGEKYAS |
| 147. | MU 8-D7 CC x I2C0-scFc VL CDR2 | artificial aa | QDRKRPS |
| 148. | MU 8-D7 CC x I2C0-scFc VL CDR3 | artificial aa | QAWGSSAAV |
| 149. | MU 8-D7 CC x I2C0-scFc VH | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWRQGTLVTVSS |
| 150. | MU 8-D7 CC x I2C0-scFc VL | artificial aa | SYELTQPSSVSVPPGQTASITCSGDKLGEKYASWYQ QKPGQSPVLIIYQDRKRPSGVPERFSGSNSGNTATLTI SGTQAMDEADYYCQAWGSSAAVFGCGTKLTVL |
| 151. | MU 8-D7 CC x I2C0-scFc scFv | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWRQGTLVTVSSGGGGSGGGGSGGGGSSYELTQP SSVSVPPGQTASITCSGDKLGEKYASWYQQKPGQSP VLIIYQDRKRPSGVPERFSGSNSGNTATLTISGTQAM DEADYYCQAWGSSAAVFGCGTKLTVLS |
| 152. | MU 8-D7 CC x I2C0-scFc Bispecific molecule | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWRQGTLVTVSSGGGGSGGGGSGGGGSSYELTQP SSVSVPPGQTASITCSGDKLGEKYASWYQQKPGQSP |

TABLE 5-continued

Sequence Table

| SEQ ID NO: | Designation | Source | Sequence |
|---|---|---|---|
| | | | VLIIYQDRKRPSGVPERFSGSNSGNTATLTISGTQAM DEADYYCQAWGSSAAVFGCGTKLTVLSGGGGSEV QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 153. | MU 8-D7 CC x I2C0-scFc Bispecific HLE molecule | artificial aa | QVQLQQWGAGLLKPSETLSLTCAVYGGSFSGYYWS WIRQPPGKCLEWIGDIDASGSTKYNPSLKSRVTISLD TSKNQFSLKLNSVTAADTAVYFCARKKYSTVWSYF DYWRQGTLVTVSSGGGGSGGGGSGGGGSSYELTQP SSVSVPPGQTASITCSGDKLGEKYASWYQQKPGQSP VLIIYQDRKRPSGVPERFSGSNSGNTATLTISGTQAM DEADYYCQAWGSSAAVFGCGTKLTVLSGGGGSEV QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 154. | MU 8-C7 CC x I2C0-scFc VH CDR1 | artificial aa | GYYWS |
| 155. | MU 8-C7 CC x I2C0-scFc VH CDR2 | artificial aa | DIDQSGSTKYNPSLKS |
| 156. | MU 8-C7 CC x I2C0-scFc VH CDR3 | artificial aa | KKYSTVWSYFDY |
| 157. | MU 8-C7 CC x I2C0-scFc VL CDR1 | artificial aa | SGDKLGDKYAS |
| 158. | MU 8-C7 CC x I2C0-scFc VL CDR2 | artificial aa | QDRKRPS |
| 159. | MU 8-C7 CC x I2C0-scFc VL CDR3 | artificial aa | QAWGSSAAV |
| 160. | MU 8-C7 CC x I2C0-scFc VH | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWRQGTLVTVSS |
| 161. | MU 8-C7 CC x I2C0-scFc VL | artificial aa | SYELTQPSSVSVPGQTASITCSGDKLGDKYASWYQ QKPGQSPVLIIYQDRKRPSGVPERFSGSNSGNTATLTI SGTQAMDEADYYCQAWGSSAAVFGCGTKLTVL |
| 162. | MU 8-C7 CC x I2C0-scFc scFv | artificial aa | QVQLQQWGAGLLKPSETLSLTCAVYGGSFSGYYWS WIRQPPGKCLEWIGDIDQSGSTKYNPSLKSRVTISLD |

TABLE 5-continued

Sequence Table

| SEQ ID NO: | Designation | Source | Sequence |
|---|---|---|---|
| | | | TSKNQFSLKLNSVTAADTAVYFCARKKYSTVWSYF DYWRQGTLVTVSSGGGGSGGGGSGGGGSSYELTQP SSVSVSPGQTASITCSGDKLGDKYASWYQQKPGQSP VLIIYQDRKRPSGVPERFSGSNSGNTATLTISGTQAM DEADYYCQAWGSSAAVFGCGTKLTVL |
| 163. | MU 8-C7 CC x I2C0-scFc Bispecific molecule | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWRQGTLVTVSSGGGGSGGGGSGGGGSSYELTQP SSVSVSPGQTASITCSGDKLGDKYASWYQQKPGQSP VLIIYQDRKRPSGVPERFSGSNSGNTATLTISGTQAM DEADYYCQAWGSSAAVFGCGTKLTVLSGGGGSEV QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 164. | MU 8-C7 CC x I2C0-scFc Bispecific HLE molecule | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWRQGTLVTVSSGGGGSGGGGSGGGGSSYELTQP SSVSVSPGQTASITCSGDKLGDKYASWYQQKPGQSP VLIIYQDRKRPSGVPERFSGSNSGNTATLTISGTQAM DEADYYCQAWGSSAAVFGCGTKLTVLSGGGGSEV QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 165. | MU 8-B8 CC x I2C0-scFc VH CDR1 | artificial aa | GYYWS |
| 166. | MU 8-B8 CC x I2C0-scFc VH CDR2 | artificial aa | DIDQSGSTKYNPSLKS |
| 167. | MU 8-B8 CC x I2C0-scFc VH CDR3 | artificial aa | KKYSTVWSYFDY |
| 168. | MU 8-B8 CC x I2C0-scFc VL CDR1 | artificial aa | SGDKLGDKYAS |
| 169. | MU 8-B8 CC x I2C0-scFc VL CDR2 | artificial aa | QDRKRPS |
| 170. | MU 8-B8 CC x I2C0-scFc VL CDR3 | artificial aa | QAWGSSAAV |

TABLE 5-continued

Sequence Table

| SEQ ID NO: | Designation | Source | Sequence |
|---|---|---|---|
| 171. | MU 8-B8 CC x I2C0-scFc VH | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSS |
| 172. | MU 8-B8 CC x I2C0-scFc VL | artificial aa | SYELTQPPSVSVPPGQTASITCSGDKLGDKYASWYQ QKPGQSPVLIIYQDRKRPSGVPERFSGSNSGNTATLTI SGTQAMDEADYYCQAWGSSAAVFGCGTKLTVL |
| 173. | MU 8-B8 CC x I2C0-scFc scFv | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSSGGGGSGGGGSGGGGSSYELTQP PSVSVPPGQTASITCSGDKLGDKYASWYQQKPGQSP VLIIYQDRKRPSGVPERFSGSNSGNTATLTISGTQAM DEADYYCQAWGSSAAVFGCGTKLTVL |
| 174. | MU 8-B8 CC x I2C0-scFc Bispecific molecule | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSSGGGGSGGGGSGGGGSSYELTQP PSVSVPPGQTASITCSGDKLGDKYASWYQQKPGQSP VLIIYQDRKRPSGVPERFSGSNSGNTATLTISGTQAM DEADYYCQAWGSSAAVFGCGTKLTVLSGGGGSEV QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 175. | MU 8-B8 CC x I2C0-scFc Bispecific HLE molecule | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSSGGGGSGGGGSGGGGSSYELTQP PSVSVPPGQTASITCSGDKLGDKYASWYQQKPGQSP VLIIYQDRKRPSGVPERFSGSNSGNTATLTISGTQAM DEADYYCQAWGSSAAVFGCGTKLTVLSGGGGSEV QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 176. | MU 8-B7 CC x I2C0-scFc VH CDR1 | artificial aa | GYYWS |
| 177. | MU 8-B7 CC x I2C0-scFc VH CDR2 | artificial aa | DIDASGSTKYNPSLKS |
| 178. | MU 8-B7 CC x I2C0-scFc VH CDR3 | artificial aa | KKYSTVWSYFDN |

TABLE 5-continued

Sequence Table

| SEQ ID NO: | Designation | Source | Sequence |
|---|---|---|---|
| 179. | MU 8-B7 CC x I2C0-scFc VL CDR1 | artificial aa | SGDKLGDKYAS |
| 180. | MU 8-B7 CC x I2C0-scFc VL CDR2 | artificial aa | QDRKRPS |
| 181. | MU 8-B7 CC x I2C0-scFc VL CDR3 | artificial aa | QAWGSSTAV |
| 182. | MU 8-B7 CC x I2C0-scFc VH | artificial aa | QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSS |
| 183. | MU 8-B7 CC x I2C0-scFc VL | artificial aa | SYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVL |
| 184. | MU 8-B7 CC x I2C0-scFc scFv | artificial aa | QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVL |
| 185. | MU 8-B7 CC x I2C0-scFc Bispecific molecule | artificial aa | QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 186. | MU 8-B7 CC x I2C0-scFc Bispecific HLE molecule | artificial aa | QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK |

TABLE 5-continued

Sequence Table

| SEQ ID NO: | Designation | Source | Sequence |
|---|---|---|---|
| 187. | MU 8-A7 CC x I2C0-scFc VH CDR1 | artificial aa | GYYWS |
| 188. | MU 8-A7 CC x I2C0-scFc VH CDR2 | artificial aa | DIDQSGSTKYNPSLKS |
| 189. | MU 8-A7 CC x I2C0-scFc VH CDR3 | artificial aa | KKYSTVWSYFDY |
| 190. | MU 8-A7 CC x I2C0-scFc VL CDR1 | artificial aa | SGDKLGDKYAS |
| 191. | MU 8-A7 CC x I2C0-scFc VL CDR2 | artificial aa | QDRKRPS |
| 192. | MU 8-A7 CC x I2C0-scFc VL CDR3 | artificial aa | QAWGSSTAV |
| 193. | MU 8-A7 CC x I2C0-scFc VH | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSS |
| 194. | MU 8-A7 CC x I2C0-scFc VL | artificial aa | SYELTQPSSVSVPPGQTASITCSGDKLGDKYASWYQ QKPGQSPVLVIYQDRKRPSGVPERFSGSNSGNTATLT ISGTQAMDEADYYCQAWGSSTAVFGCGTKLTVL |
| 195. | MU 8-A7 CC x I2C0-scFc scFv | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSSGGGGSGGGGSGGGGSSYELTQP SSVSVPPGQTASITCSGDKLGDKYASWYQQKPGQSP VLVIYQDRKRPSGVPERFSGSNSGNTATLTISGTQAM DEADYYCQAWGSSTAVFGCGTKLTVL |
| 196. | MU 8-A7 CC x I2C0-scFc Bispecific molecule | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSSGGGGSGGGGSGGGGSSYELTQP SSVSVPPGQTASITCSGDKLGDKYASWYQQKPGQSP VLVIYQDRKRPSGVPERFSGSNSGNTATLTISGTQAM DEADYYCQAWGSSTAVFGCGTKLTVLSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 197. | MU 8-A7 CC x I2C0-scFc Bispecific HLE molecule | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSSGGGGSGGGGSGGGGSSYELTQP SSVSVPPGQTASITCSGDKLGDKYASWYQQKPGQSP VLVIYQDRKRPSGVPERFSGSNSGNTATLTISGTQAM DEADYYCQAWGSSTAVFGCGTKLTVLSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM |

TABLE 5-continued

Sequence Table

| SEQ ID NO: | Designation | Source | Sequence |
|---|---|---|---|
| | | | TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 198. | MU 7-G6 CC x I2C0-scFc VH CDR1 | artificial aa | SYGMH |
| 199. | MU 7-G6 CC x I2C0-scFc VH CDR2 | artificial aa | VIWYSGSNKYYATSVKG |
| 200. | MU 7-G6 CC x I2C0-scFc VH CDR3 | artificial aa | GAYTYGFDY |
| 201. | MU 7-G6 CC x I2C0-scFc VL CDR1 | artificial aa | RASQSINRYLA |
| 202. | MU 7-G6 CC x I2C0-scFc VL CDR2 | artificial aa | TASNRAT |
| 203. | MU 7-G6 CC x I2C0-scFc VL CDR3 | artificial aa | HHYGSSIFT |
| 204. | MU 7-G6 CC x I2C0-scFc VH | artificial aa | QVQLVESGGGVVKPGGSLRLSCAASGFTFSSYGMH WVRQAPGKCLEWVAVIWYSGSNKYYATSVKGRFTI SRDNSKNTLYLQMNNLRAEDTAVYYCARGAYTYG FDYWGQGTLVTVSS |
| 205. | MU 7-G6 CC x I2C0-scFc VL | artificial aa | EIVLTQSPGTLSLSPGERATLSCRASQSINRYLAWYQ QKPGQAPRLLIYTASNRATGIPDRFSGSGSGTDFTLTI SRLEPEDFAVYYCHHYGSSIFTFGCGTKVEIK |
| 206. | MU 7-G6 CC x I2C0-scFc scFv | artificial aa | QVQLVESGGGVVKPGGSLRLSCAASGFTFSSYGMH WVRQAPGKCLEWVAVIWYSGSNKYYATSVKGRFTI SRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIK |
| 207. | MU 7-G6 CC x I2C0-scFc Bispecific molecule | artificial aa | QVQLVESGGGVVKPGGSLRLSCAASGFTFSSYGMH WVRQAPGKCLEWVAVIWYSGSNKYYATSVKGRFTI SRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 208. | MU 7-G6 CC x I2C0-scFc Bispecific HLE molecule | artificial aa | QVQLVESGGGVVKPGGSLRLSCAASGFTFSSYGMH WVRQAPGKCLEWVAVIWYSGSNKYYATSVKGRFTI SRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ |

TABLE 5-continued

Sequence Table

| SEQ ID NO: | Designation | Source | Sequence |
|---|---|---|---|
| | | | LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 209. | MU 6-B12 CC x I2C0-scFc VH CDR1 | artificial aa | SYGMH |
| 210. | MU 6-B12 CC x I2C0-scFc VH CDR2 | artificial aa | VIWFDASNKYYAESVKG |
| 211. | MU 6-B12 CC x I2C0-scFc VH CDR3 | artificial aa | GAYTYGFDY |
| 212. | MU 6-B12 CC x I2C0-scFc VL CDR1 | artificial aa | RASQSINRYLA |
| 213. | MU 6-B12 CC x I2C0-scFc VL CDR2 | artificial aa | TASNRAT |
| 214. | MU 6-B12 CC x I2C0-scFc VL CDR3 | artificial aa | HHYGSSIFT |
| 215. | MU 6-B12 CC x I2C0-scFc VH | artificial aa | QVQLVESGGGVVKPGRSLRLSCAASGFTFSSYGMH WVRQAPGKCLEWVAVIWFDASNKYYAESVKGRFTI SRDNSKNTLYLQMNNLRAEDTAVYYCARGAYTYG FDYWGQGTLVTVSS |
| 216. | MU 6-B12 CC x I2C0-scFc VL | artificial aa | EIVLTQSPGTLSLSPGERATLSCRASQSINRYLAWYQ QKPGQAPRLLIYTASNRATGIPDRFSGSGSGTDFTLTI SRLEPEDFAVYYCHHYGSSIFTFGCGTKVEIK |
| 217. | MU 6-B12 CC x I2C0-scFc scFv | artificial aa | QVQLVESGGGVVKPGRSLRLSCAASGFTFSSYGMH WVRQAPGKCLEWVAVIWFDASNKYYAESVKGRFTI SRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIK |
| 218. | MU 6-B12 CC x I2C0-scFc Bispecific molecule | artificial aa | QVQLVESGGGVVKPGRSLRLSCAASGFTFSSYGMH WVRQAPGKCLEWVAVIWFDASNKYYAESVKGRFTI SRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW |

TABLE 5-continued

Sequence Table

| SEQ ID NO: | Designation | Source | Sequence |
|---|---|---|---|
| | | | VQQKPGQAPRGLIGGTKFLAPGTPARFSGSLLGGKA ALTLSGVQPEDEAEYYCVLWYSNRWVFGGGTKLTV L |
| 219. | MU 6-B12 CC x I2C0-scFc Bispecific HLE molecule | artificial aa | QVQLVESGGGVVKPGRSLRLSCAASGFTFSSYGMH WVRQAPGKCLEWVAVIWFDASNKYYAESVKGRFTI SRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 220. | MU 5-H4 CC x I2C0-scFc VH CDR1 | artificial aa | SYGMH |
| 221. | MU 5-H4 CC x I2C0-scFc VH CDR2 | artificial aa | VIWFQGSNKYYADAVKG |
| 222. | MU 5-H4 CC x I2C0-scFc VH CDR3 | artificial aa | GGYTYGFDY |
| 223. | MU 5-H4 CC x I2C0-scFc VL CDR1 | artificial aa | RASQSINRYLA |
| 224. | MU 5-H4 CC x I2C0-scFc VL CDR2 | artificial aa | TASNRAT |
| 225. | MU 5-H4 CC x I2C0-scFc VL CDR3 | artificial aa | HHYGSSIFT |
| 226. | MU 5-H4 CC x I2C0-scFc VH | artificial aa | QVQLVESGGGLVQPGGSLRLSCAASGFTFSSYGMH WVRQAPGKCLEWVAVIWFQGSNKYYADAVKGRFT ISRDNSKNTLYLQMNNLRAEDTAVYYCARGGYTYG FDYWGQGTLVTVSS |
| 227. | MU 5-H4 CC x I2C0-scFc VL | artificial aa | EIVLTQSPGTLSLSPGERATLSCRASQSINRYLAWYQ QKPGQAPRLLIYTASNRATGIPDRFSGSGSGTDFTLTI SRLEPEDFAVYYCHHYGSSIFTFGCGTKVEIK |
| 228. | MU 5-H4 CC x I2C0-scFc scFv | artificial aa | QVQLVESGGGLVQPGGSLRLSCAASGFTFSSYGMH WVRQAPGKCLEWVAVIWFQGSNKYYADAVKGRFT ISRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIK |

TABLE 5-continued

Sequence Table

| SEQ ID NO: | Designation | Source | Sequence |
|---|---|---|---|
| 229. | MU 5-H4 CC x I2C0-scFc Bispecific molecule | artificial aa | QVQLVESGGGLVQPGGSLRLSCAASGFTFSSYGMH WVRQAPGKCLEWVAVIWFQGSNKYYADAVKGRFT ISRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 230. | MU 5-H4 CC x I2C0-scFc Bispecific HLE molecule | artificial aa | QVQLVESGGGLVQPGGSLRLSCAASGFTFSSYGMH WVRQAPGKCLEWVAVIWFQGSNKYYADAVKGRFT ISRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 231. | MU 5-H1 CC x I2C0-scFc VH CDR1 | artificial aa | SGGYNWA |
| 232. | MU 5-H1 CC x I2C0-scFc VH CDR2 | artificial aa | YIYYSGSTYYNPSLKS |
| 233. | MU 5-H1 CC x I2C0-scFc VH CDR3 | artificial aa | EKYSSRWTFFDY |
| 234. | MU 5-H1 CC x I2C0-scFc VL CDR1 | artificial aa | SGDKLGDNYAS |
| 235. | MU 5-H1 CC x I2C0-scFc VL CDR2 | artificial aa | HDNKRPS |
| 236. | MU 5-H1 CC x I2C0-scFc VL CDR3 | artificial aa | QAFQSSTVV |
| 237. | MU 5-H1 CC x I2C0-scFc VH | artificial aa | QVQLQESGPGLVKPSETLSLTCTVSGDSISSGGYNW AWIRQHPGKCLEWIGYIYYSGSTYYNPSLKSRVTISV DTSKNQFSLKLSSVTAADTAVYYCAREKYSSRWTFF DYWGQGTLVTVSS |

TABLE 5-continued

Sequence Table

| SEQ ID NO: | Designation | Source | Sequence |
|---|---|---|---|
| 238. | MU 5-H1 CC x I2C0-scFc VL | artificial aa | SYELTQPPSVSVSPGQTASITCSGDKLGDNYASWYQ QKPGQSPVLVIYHDNKRPSGIPERFSGSNSGNTATLTI SGTQAMDEADYYCQAFQSSTVVFGCGTKLTVL |
| 239. | MU 5-H1 CC x I2C0-scFc scFv | artificial aa | QVQLQESGPGLVKPSETLSLTCTVSGDSISSGGYNW AWIRQHPGKCLEWIGYIYYSGSTYYNPSLKSRVTISV DTSKNQFSLKLSSVTAADTAVYYCAREKYSSRWTFF DYWGQGTLVTVSSGGGGSGGGGSGGGGSSYELTQP PSVSVSPGQTASITCSGDKLGDNYASWYQQKPGQSP VLVIYHDNKRPSGIPERFSGSNSGNTATLTISGTQAM DEADYYCQAFQSSTVVFGCGTKLTVL |
| 240. | MU 5-H1 CC x I2C0-scFc Bispecific molecule | artificial aa | QVQLQESGPGLVKPSETLSLTCTVSGDSISSGGYNW AWIRQHPGKCLEWIGYIYYSGSTYYNPSLKSRVTISV DTSKNQFSLKLSSVTAADTAVYYCAREKYSSRWTFF DYWGQGTLVTVSSGGGGSGGGGSGGGGSSYELTQP PSVSVSPGQTASITCSGDKLGDNYASWYQQKPGQSP VLVIYHDNKRPSGIPERFSGSNSGNTATLTISGTQAM DEADYYCQAFQSSTVVFGCGTKLTVLSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 241. | MU 5-H1 CC x I2C0-scFc Bispecific HLE molecule | artificial aa | QVQLQESGPGLVKPSETLSLTCTVSGDSISSGGYNW AWIRQHPGKCLEWIGYIYYSGSTYYNPSLKSRVTISV DTSKNQFSLKLSSVTAADTAVYYCAREKYSSRWTFF DYWGQGTLVTVSSGGGGSGGGGSGGGGSSYELTQP PSVSVSPGQTASITCSGDKLGDNYASWYQQKPGQSP VLVIYHDNKRPSGIPERFSGSNSGNTATLTISGTQAM DEADYYCQAFQSSTVVFGCGTKLTVLSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 242. | MU 4-H11 CC x I2C0-scFc VH CDR1 | artificial aa | NFGMH |
| 243. | MU 4-H11 CC x I2C0-scFc VH CDR2 | artificial aa | VIWFDASKTYYAEAVKG |
| 244. | MU 4-H11 CC x I2C0-scFc VH CDR3 | artificial aa | ATYSTGWSYFDY |
| 245. | MU 4-H11 CC x I2C0-scFc VL CDR1 | artificial aa | SGDKLGDKYTS |

TABLE 5-continued

Sequence Table

| SEQ ID NO: | Designation | Source | Sequence |
|---|---|---|---|
| 246. | MU 4-H11 CC x I2C0-scFc VL CDR2 | artificial aa | HDAKRPS |
| 247. | MU 4-H11 CC x I2C0-scFc VL CDR3 | artificial aa | QAYEASTAWV |
| 248. | MU 4-H11 CC x I2C0-scFc VH | artificial aa | QVQLVESGGGVVQPGRSLRLSCAASGFTFSNFGMH WVRQAPGKCLEWVAVIWFDASKTYYAEAVKGRFTI SRDTSMNTLYLQMNSLRAEDTAVYYCARATYSTG WSYFDYWGQGTLVTVSS |
| 249. | MU 4-H11 CC x I2C0-scFc VL | artificial aa | SYELTQPPSVSVSPGQTASITCSGDKLGDKYTSWYQ QKPGQSPVLVIYHDAKRPSGIPERFSGSNSGNTATLTI SGTQAMDEADYYCQAYEASTAWVFGCGTKLTVL |
| 250. | MU 4-H11 CC x I2C0-scFc scFv | artificial aa | QVQLVESGGGVVQPGRSLRLSCAASGFTFSNFGMH WVRQAPGKCLEWVAVIWFDASKTYYAEAVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAYEASTAWVFGCGTKLTVL |
| 251. | MU 4-H11 CC x I2C0-scFc Bispecific molecule | artificial aa | QVQLVESGGGVVQPGRSLRLSCAASGFTFSNFGMH WVRQAPGKCLEWVAVIWFDASKTYYAEAVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAYEASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVL |
| 252. | MU 4-H11 CC x I2C0-scFc Bispecific HLE molecule | artificial aa | QVQLVESGGGVVQPGRSLRLSCAASGFTFSNFGMH WVRQAPGKCLEWVAVIWFDASKTYYAEAVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAYEASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGSDKTHTCPPCPAPELLGGPS VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |
| 253. | MU 4-H2 CC x I2C0-scFc VH CDR1 | artificial aa | NFGMH |

TABLE 5-continued

Sequence Table

| SEQ ID NO: | Designation | Source | Sequence |
|---|---|---|---|
| 254. | MU 4-H2 CC x I2C0-scFc VH CDR2 | artificial aa | VIWFDASKTYYAESVKG |
| 255. | MU 4-H2 CC x I2C0-scFc VH CDR3 | artificial aa | ATYSTGWSYFDY |
| 256. | MU 4-H2 CC x I2C0-scFc VL CDR1 | artificial aa | SGDKLGDKYTS |
| 257. | MU 4-H2 CC x I2C0-scFc VL CDR2 | artificial aa | HDAKRPS |
| 258. | MU 4-H2 CC x I2C0-scFc VL CDR3 | artificial aa | QAWEASTAWV |
| 259. | MU 4-H2 CC x I2C0-scFc VH | artificial aa | QVQLVESGGGVVQPGRSLRLSCAASGFTFSNFGMH WVRQAPGKCLEWVAVIWFDASKTYYAESVKGRFTI SRDTSMNTLYLQMNSLRAEDTAVYYCARATYSTG WSYFDYWGQGTLVTVSS |
| 260. | MU 4-H2 CC x I2C0-scFc VL | artificial aa | SYELTQPPSVSVSPGQTASITCSGDKLGDKYTSWYQ QKPGQSPVLVIYHDAKRPSGIPERFSGSNSGNTATLTI SGTQAMDEADYYCQAWEASTAWVFGCGTKLTVL |
| 261. | MU 4-H2 CC x I2C0-scFc scFv | artificial aa | QVQLVESGGGVVQPGRSLRLSCAASGFTFSNFGMH WVRQAPGKCLEWVAVIWFDASKTYYAESVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWEASTAWVFGCGTKLTVL |
| 262. | MU 4-H2 CC x I2C0-scFc Bispecific molecule | artificial aa | QVQLVESGGGVVQPGRSLRLSCAASGFTFSNFGMH WVRQAPGKCLEWVAVIWFDASKTYYAESVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWEASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVL |
| 263. | MU 4-H2 CC x I2C0-scFc Bispecific HLE molecule | artificial aa | QVQLVESGGGVVQPGRSLRLSCAASGFTFSNFGMH WVRQAPGKCLEWVAVIWFDASKTYYAESVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWEASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGGSDKTHTCPPCPAPELLGGPS |

TABLE 5-continued

Sequence Table

| SEQ ID NO: | Designation | Source | Sequence |
|---|---|---|---|
| | | | VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |
| 264. | MU 4-G4 CC x I2C0-scFc VH CDR1 | artificial aa | NFGMH |
| 265. | MU 4-G4 CC x I2C0-scFc VH CDR2 | artificial aa | VIWFDASKTYYADAVKG |
| 266. | MU 4-G4 CC x I2C0-scFc VH CDR3 | artificial aa | ATYSTGWSYFDY |
| 267. | MU 4-G4 CC x I2C0-scFc VL CDR1 | artificial aa | SGDKLGDKYTS |
| 268. | MU 4-G4 CC x I2C0-scFc VL CDR2 | artificial aa | HDAKRPS |
| 269. | MU 4-G4 CC x I2C0-scFc VL CDR3 | artificial aa | QAWDASTAWV |
| 270. | MU 4-G4 CC x I2C0-scFc VH | artificial aa | QVQLVESGGGVVQPGRSLRLSCAASGFTFSNFGMH WVRQAPGKCLEWVAVIWFDASKTYYADAVKGRFT ISRDTSMNTLYLQMNSLRAEDTAVYYCARATYSTG WSYFDYWGQGTLVTVSS |
| 271. | MU 4-G4 CC x I2C0-scFc VL | artificial aa | SYELTQPPSVSVSPGQTASITCSGDKLGDKYTSWYQ QKPGQSPVLVIYHDAKRPSGIPERFSGSNSGNTATLTI SGTQAMDEADYYCQAWDASTAWVFGCGTKLTVL |
| 272. | MU 4-G4 CC x I2C0-scFc scFv | artificial aa | QVQLVESGGGVVQPGRSLRLSCAASGFTFSNFGMH WVRQAPGKCLEWVAVIWFDASKTYYADAVKGRFT ISRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWDASTAWVFGCGTKLTVL |
| 273. | MU 4-G4 CC x I2C0-scFc Bispecific molecule | artificial aa | QVQLVESGGGVVQPGRSLRLSCAASGFTFSNFGMH WVRQAPGKCLEWVAVIWFDASKTYYADAVKGRFT ISRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWDASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLCGSSTGAVTSGN YPNWVQQKPGQAPRGLIGGTKFLAPGTPARFSGSLL GGKAALTLSGVQPEDEAEYYCVLWYSNRWVFGGG TKLTVL |
| 274. | MU 4-G4 CC x I2C0-scFc Bispecific HLE molecule | artificial aa | QVQLVESGGGVVQPGRSLRLSCAASGFTFSNFGMH WVRQAPGKCLEWVAVIWFDASKTYYADAVKGRFT ISRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWDASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG |

TABLE 5-continued

Sequence Table

| SEQ ID NO: | Designation | Source | Sequence |
|---|---|---|---|
| | | | GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGGGSDKTHTCPPCPAPELLGGPS VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |
| 275. | MU 4-F6 CC x I2C0-scFc VH CDR1 | artificial aa | NFGMH |
| 276. | MU 4-F6 CC x I2C0-scFc VH CDR2 | artificial aa | VIWFDASKTYYASSVKG |
| 277. | MU 4-F6 CC x I2C0-scFc VH CDR3 | artificial aa | ATYSTGWSYFDY |
| 278. | MU 4-F6 CC x I2C0-scFc VL CDR1 | artificial aa | SGDKLGDKYTS |
| 279. | MU 4-F6 CC x I2C0-scFc VL CDR2 | artificial aa | HDAKRPS |
| 280. | MU 4-F6 CC x I2C0-scFc VL CDR3 | artificial aa | QAYSASTAWV |
| 281. | MU 4-F6 CC x I2C0-scFc VH | artificial aa | QVQLVESGGGVVQPGRSLRLSCAASGFTFSNFGMH WVRQAPGKCLEWVAVIWFDASKTYYASSVKGRFTI SRDTSMNTLYLQMNSLRAEDTAVYYCARATYSTG WSYFDYWGQGTLVTVSS |
| 282. | MU 4-F6 CC x I2C0-scFc VL | artificial aa | SYELTQPPSVSVSPGQTASITCSGDKLGDKYTSWYQ QKPGQSPVLVIYHDAKRPSGIPERFSGSNSGNTATLTI SGTQAMDEADYYCQAYSASTAWVFGCGTKLTVL |
| 283. | MU 4-F6 CC x I2C0-scFc scFv | artificial aa | QVQLVESGGGVVQPGRSLRLSCAASGFTFSNFGMH WVRQAPGKCLEWVAVIWFDASKTYYASSVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAYSASTAWVFGCGTKLTVL |
| 284. | MU 4-F6 CC x I2C0-scFc Bispecific molecule | artificial aa | QVQLVESGGGVVQPGRSLRLSCAASGFTFSNFGMH WVRQAPGKCLEWVAVIWFDASKTYYASSVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAYSASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVL |

TABLE 5-continued

Sequence Table

| SEQ ID NO: | Designation | Source | Sequence |
|---|---|---|---|
| 285. | MU 4-F6 CC x I2C0-scFc Bispecific HLE molecule | artificial aa | QVQLVESGGGVVQPGRSLRLSCAASGFTFSNFGMH WVRQAPGKCLEWVAVIWFDASKTYYASSVKGRFTI SRDTSMNTLYLQMNSLRAEDTAVYYCARATYSTG WSYFDYWGQGTLVTSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAYSASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGGGSDKTHTCPPCPAPELLGGPS VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |
| 286. | MU 4-E7 CC x I2C0-scFc VH CDR1 | artificial aa | GYYWS |
| 287. | MU 4-E7 CC x I2C0-scFc VH CDR2 | artificial aa | DIDYSGSTKYNPSLKS |
| 288. | MU 4-E7 CC x I2C0-scFc VH CDR3 | artificial aa | KKYSTVWSYFDY |
| 289. | MU 4-E7 CC x I2C0-scFc VL CDR1 | artificial aa | SGDKLGEKYAS |
| 290. | MU 4-E7 CC x I2C0-scFc VL CDR2 | artificial aa | QDRKRPS |
| 291. | MU 4-E7 CC x I2C0-scFc VL CDR3 | artificial aa | QAWGSSAAV |
| 292. | MU 4-E7 CC x I2C0-scFc VH | artificial aa | QVQLQQWGAGLLKPSETLSLTCAVYGGSFSGYYWS WIRQPPGKCLEWIGDIDYSGSTKYNPSLKSRVTISLD TSKNQFSLKLNSVTAADTAVYFCARKKYSTVWSYF DYWGQGTLVTVSS |
| 293. | MU 4-E7 CC x I2C0-scFc VL | artificial aa | SYELTQPSSVSVSPGQTASITCSGDKLGEKYASWYQ QKPGQSPVLIIYQDRKRPSGVPERFSGSNSGNTATLTI SGTQAMDEADYYCQAWGSSAAVFGCGTKLTVL |
| 294. | MU 4-E7 CC x I2C0-scFc scFv | artificial aa | QVQLQQWGAGLLKPSETLSLTCAVYGGSFSGYYWS WIRQPPGKCLEWIGDIDYSGSTKYNPSLKSRVTISLD TSKNQFSLKLNSVTAADTAVYFCARKKYSTVWSYF DYWGQGTLVTVSSGGGGSGGGGSGGGGSSYELTQP SSVSVSPGQTASITCSGDKLGEKYASWYQQKPGQSP VLIIYQDRKRPSGVPERFSGSNSGNTATLTISGTQAM DEADYYCQAWGSSAAVFGCGTKLTVL |
| 295. | MU 4-E7 CC x I2C0-scFc Bispecific molecule | artificial aa | QVQLQQWGAGLLKPSETLSLTCAVYGGSFSGYYWS WIRQPPGKCLEWIGDIDYSGSTKYNPSLKSRVTISLD TSKNQFSLKLNSVTAADTAVYFCARKKYSTVWSYF DYWGQGTLVTVSSGGGGSGGGGSGGGGSSYELTQP SSVSVSPGQTASITCSGDKLGEKYASWYQQKPGQSP |

TABLE 5-continued

Sequence Table

| SEQ ID NO: | Designation | Source | Sequence |
|---|---|---|---|
| | | | VLIIYQDRKRPSGVPERFSGSNSGNTATLTISGTQAM DEADYYCQAWGSSAAVFGCGTKLTVLSGGGGSEV QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 296. | MU 4-E7 CC x I2C0-scFc Bispecific HLE molecule | artificial aa | QVQLQQWGAGLLKPSETLSLTCAVYGGSFSGYYWS WIRQPPGKCLEWIGDIDYSGSTKYNPSLKSRVTISLD TSKNQFSLKLNSVTAADTAVYFCARKKYSTVWSYF DYWGQGTLVTVSSGGGGSGGGGSGGGGSSYELTQP SSVSVSPGQTASITCSGDKLGEKYASWYQQKPGQSP VLIIYQDRKRPSGVPERFSGSNSGNTATLTISGTQAM DEADYYCQAWGSSAAVFGCGTKLTVLSGGGGSEV QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 297. | MU 4-C11 CC x I2C0-scFc VH CDR1 | artificial aa | SYGMH |
| 298. | MU 4-C11 CC x I2C0-scFc VH CDR2 | artificial aa | VISYDASNKYYASAVKG |
| 299. | MU 4-C11 CC x I2C0-scFc VH CDR3 | artificial aa | GAYTYGFDY |
| 300. | MU 4-C11 CC x I2C0-scFc VL CDR1 | artificial aa | RASQSVNRYLA |
| 301. | MU 4-C11 CC x I2C0-scFc VL CDR2 | artificial aa | GASNRAT |
| 302. | MU 4-C11 CC x I2C0-scFc VL CDR3 | artificial aa | HHYGSSIFA |
| 303. | MU 4-C11 CC x I2C0-scFc VH | artificial aa | QVQLVESGGGVVQPGRSLRLSCAASGFTFSSYGMH WVRQAPGKCLEWVAVISYDASNKYYASAVKGRFTI SRDNSKNTLYLQMNSLRAEDTAVYYCARGAYTYGF DYWGQGTLVTVSS |
| 304. | MU 4-C11 CC x I2C0-scFc VL | artificial aa | EIVLTQSPGTLSLSPGERATLSCRASQSVNRYLAWY QQKPGQAPRLLIYGASNRATGIPDRFTGSGSGTDFTL TISRLEPEDFAVYFCHHYGSSIFAFGCGTKVEIK |
| 305. | MU 4-C11 CC x I2C0-scFc scFv | artificial aa | QVQLVESGGGVVQPGRSLRLSCAASGFTFSSYGMH WVRQAPGKCLEWVAVISYDASNKYYASAVKGRFTI |

TABLE 5-continued

Sequence Table

| SEQ ID NO: | Designation | Source | Sequence |
|---|---|---|---|
| | | | SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIK |
| 306. | MU 4-C11 CC x I2C0-scFc Bispecific molecule | artificial aa | QVQLVESGGGVVQPGRSLRLSCAASGFTFSSYGMH WVRQAPGKCLEWVAVISYDASNKYYASAVKGRFTI SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 307. | MU 4-C11 CC x I2C0-scFc Bispecific HLE molecule | artificial aa | QVQLVESGGGVVQPGRSLRLSCAASGFTFSSYGMH WVRQAPGKCLEWVAVISYDASNKYYASAVKGRFTI SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 308. | MU 4-C4 CC x I2C0-scFc VH CDR1 | artificial aa | SYGMH |
| 309. | MU 4-C4 CC x I2C0-scFc VH CDR2 | artificial aa | VIWFDASNKYYAESVKG |
| 310. | MU 4-C4 CC x I2C0-scFc VH CDR3 | artificial aa | GAYTYGFDY |
| 311. | MU 4-C4 CC x I2C0-scFc VL CDR1 | artificial aa | RASQSVNRYLA |
| 312. | MU 4-C4 CC x I2C0-scFc VL CDR2 | artificial aa | GASNRAT |
| 313. | MU 4-C4 CC x I2C0-scFc VL CDR3 | artificial aa | HHYGSSIFA |

TABLE 5-continued

Sequence Table

| SEQ ID NO: | Designation | Source | Sequence |
|---|---|---|---|
| 314. | MU 4-C4 CC x I2C0-scFc VH | artificial aa | QVQLVESGGGVVQPGRSLRLSCAASGFTFSSYGMH WVRQAPGKCLEWVAVIWFDASNKYYAESVKGRFTI SRDNSKNTLYLQMNSLRAEDTAVYYCARGAYTYGF DYWGQGTLVTVSS |
| 315. | MU 4-C4 CC x I2C0-scFc VL | artificial aa | EIVLTQSPGTLSLSPGERATLSCRASQSVNRYLAWY QQKPGQAPRLLIYGASNRATGIPDRFTGSGSGTDFTL TISRLEPEDFAVYFCHHYGSSIFAFGCGTKVEIK |
| 316. | MU 4-C4 CC x I2C0-scFc scFv | artificial aa | QVQLVESGGGVVQPGRSLRLSCAASGFTFSSYGMH WVRQAPGKCLEWVAVIWFDASNKYYAESVKGRFTI SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIK |
| 317. | MU 4-C4 CC x I2C0-scFc Bispecific molecule | artificial aa | QVQLVESGGGVVQPGRSLRLSCAASGFTFSSYGMH WVRQAPGKCLEWVAVIWFDASNKYYAESVKGRFTI SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 318. | MU 4-C4 CC x I2C0-scFc Bispecific HLE molecule | artificial aa | QVQLVESGGGVVQPGRSLRLSCAASGFTFSSYGMH WVRQAPGKCLEWVAVIWFDASNKYYAESVKGRFTI SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 319. | MU 4-C3 CC x I2C0-scFc VH CDR1 | artificial aa | SYGMH |
| 320. | MU 4-C3 CC x I2C0-scFc VH CDR2 | artificial aa | VISYEGSNKYYAESVKG |
| 321. | MU 4-C3 CC x I2C0-scFc VH CDR3 | artificial aa | GAYTYGFDY |

TABLE 5-continued

Sequence Table

| SEQ ID NO: | Designation | Source | Sequence |
|---|---|---|---|
| 322. | MU 4-C3 CC x I2C0-scFc VL CDR1 | artificial aa | RASQSVNRYLA |
| 323. | MU 4-C3 CC x I2C0-scFc VL CDR2 | artificial aa | GASNRAT |
| 324. | MU 4-C3 CC x I2C0-scFc VL CDR3 | artificial aa | HHYGSSIFA |
| 325. | MU 4-C3 CC x I2C0-scFc VH | artificial aa | QVQLVESGGGVVQPGRSLRLSCAASGFTFSSYGMH WVRQAPGKCLEWVAVISYEGSNKYYAESVKGRFTI SRDNSKNTLYLQMNSLRAEDTAVYYCARGAYTYGF DYWGQGTLVTVSS |
| 326. | MU 4-C3 CC x I2C0-scFc VL | artificial aa | EIVLTQSPGTLSLSPGERATLSCRASQSVNRYLAWY QQKPGQAPRLLIYGASNRATGIPDRFTGSGSGTDFTL TISRLEPEDFAVYFCHHYGSSIFAFGCGTKVEIK |
| 327. | MU 4-C3 CC x I2C0-scFc | artificial aa | QVQLVESGGGVVQPGRSLRLSCAASGFTFSSYGMH WVRQAPGKCLEWVAVISYEGSNKYYAESVKGRFTI SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIK |
| 328. | MU 4-C3 CC x I2C0-scFc Bispecific molecule | artificial aa | QVQLVESGGGVVQPGRSLRLSCAASGFTFSSYGMH WVRQAPGKCLEWVAVISYEGSNKYYAESVKGRFTI SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 329. | MU 4-C3 CC x I2C0-scFc Bispecific HLE molecule | artificial aa | QVQLVESGGGVVQPGRSLRLSCAASGFTFSSYGMH WVRQAPGKCLEWVAVISYEGSNKYYAESVKGRFTI SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |

TABLE 5-continued

Sequence Table

| SEQ ID NO: | Designation | Source | Sequence |
|---|---|---|---|
| 330. | MU 4-B10 CC x I2C0-scFc VH CDR1 | artificial aa | NFGMH |
| 331. | MU 4-B10 CC x I2C0-scFc VH CDR2 | artificial aa | VIWFDASKTYYASSVKG |
| 332. | MU 4-B10 CC x I2C0-scFc VH CDR3 | artificial aa | ATYSTGWSYFDY |
| 333. | MU 4-B10 CC x I2C0-scFc VL CDR1 | artificial aa | SGDKLGDKYTS |
| 334. | MU 4-B10 CC x I2C0-scFc VL CDR2 | artificial aa | HDAKRPS |
| 335. | MU 4-B10 CC x I2C0-scFc VL CDR3 | artificial aa | QAWSASTAWV |
| 336. | MU 4-B10 CC x I2C0-scFc VH | artificial aa | QVQLVESGGGVVQPGRSLRLSCAASGFTFSNFGMH WVRQAPGKCLEWVAVIWFDASKTYYASSVKGRFTI SRDTSMNTLYLQMNSLRAEDTAVYYCARATYSTG WSYFDYWGQGTLVTVSS |
| 337. | MU 4-B10 CC x I2C0-scFc VL | artificial aa | SYELTQPPSVSVSPGQTASITCSGDKLGDKYTSWYQ QKPGQSPVLVIYHDAKRPSGIPERFSGSNSGNTATLTI SGTQAMDEADYYCQAWSASTAWVFGCGTKLTVL |
| 338. | MU 4-B10 CC x I2C0-scFc scFv | artificial aa | QVQLVESGGGVVQPGRSLRLSCAASGFTFSNFGMH WVRQAPGKCLEWVAVIWFDASKTYYASSVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVL |
| 339. | MU 4-B10 CC x I2C0-scFc Bispecific molecule | artificial aa | QVQLVESGGGVVQPGRSLRLSCAASGFTFSNFGMH WVRQAPGKCLEWVAVIWFDASKTYYASSVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVL |
| 340. | MU 4-B10 CC x I2C0-scFc Bispecific HLE molecule | artificial aa | QVQLVESGGGVVQPGRSLRLSCAASGFTFSNFGMH WVRQAPGKCLEWVAVIWFDASKTYYASSVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS |

TABLE 5-continued

Sequence Table

| SEQ ID NO: | Designation | Source | Sequence |
|---|---|---|---|
| | | | REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGGGSDKTHTCPPCPAPELLGGPS VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |
| 341. | MU 4-B6 CC x I2C0-scFc VH CDR1 | artificial aa | SYGMH |
| 342. | MU 4-B6 CC x I2C0-scFc VH CDR2 | artificial aa | VISYDASNKYYASSVKG |
| 343. | MU 4-B6 CC x I2C0-scFc VH CDR3 | artificial aa | GAYTYGFDY |
| 344. | MU 4-B6 CC x I2C0-scFc VL CDR1 | artificial aa | RASQSVNRYLA |
| 345. | MU 4-B6 CC x I2C0-scFc VL CDR2 | artificial aa | GASNRAT |
| 346. | MU 4-B6 CC x I2C0-scFc VL CDR3 | artificial aa | HHYGSSIFA |
| 347. | MU 4-B6 CC x I2C0-scFc VH | artificial aa | QVQLVESGGGVVQPGRSLRLSCAASGFTFSSYGMH WVRQAPGKCLEWVAVISYDASNKYYASSVKGRFTI SRDNSKNTLYLQMNSLRAEDTAVYYCARGAYTYGF DYWGQGTLVTVSS |
| 348. | MU 4-B6 CC x I2C0-scFc VL | artificial aa | EIVLTQSPGTLSLSPGERATLSCRASQSVNRYLAWY QQKPGQAPRLLIYGASNRATGIPDRFTGSGSGTDFTL TISRLEPEDFAVYFCHHYGSSIFAFGCGTKVEIK |
| 349. | MU 4-B6 CC x I2C0-scFc scFv | artificial aa | QVQLVESGGGVVQPGRSLRLSCAASGFTFSSYGMH WVRQAPGKCLEWVAVISYDASNKYYASSVKGRFTI SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIK |
| 350. | MU 4-B6 CC x I2C0-scFc Bispecific molecule | artificial aa | QVQLVESGGGVVQPGRSLRLSCAASGFTFSSYGMH WVRQAPGKCLEWVAVISYDASNKYYASSVKGRFTI SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 351. | MU 4-B6 CC x I2C0-scFc Bispecific HLE molecule | artificial aa | QVQLVESGGGVVQPGRSLRLSCAASGFTFSSYGMH WVRQAPGKCLEWVAVISYDASNKYYASSVKGRFTI SRDNSKNTLYLQMNSLRAEDTAVYYCARGAYTYGF DYWGQGTLVTVSSGGGGSGGGGSGGGGSEIVLTQS PGTLSLSPGERATLSCRASQSVNRYLAWYQQKPGQ APRLLIYGASNRATGIPDRFTGSGSGTDFTLTISRLEP EDFAVYFCHHYGSSIFAFGCGTKVEIKSGGGGSEVQ |

TABLE 5-continued

Sequence Table

| SEQ ID NO: | Designation | Source | Sequence |
|---|---|---|---|
| | | | LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 352. | MU 4-B1 CC x I2C0-scFc VH CDR1 | artificial aa | NFGMH |
| 353. | MU 4-B1 CC x I2C0-scFc VH CDR2 | artificial aa | VIWFDASKTYYAESVKG |
| 354. | MU 4-B1 CC x I2C0-scFc VH CDR3 | artificial aa | ATYSTGWSYFDY |
| 355. | MU 4-B1 CC x I2C0-scFc VL CDR1 | artificial aa | SGDKLGDKYTS |
| 356. | MU 4-B1 CC x I2C0-scFc VL CDR2 | artificial aa | HDAKRPS |
| 357. | MU 4-B1 CC x I2C0-scFc VL CDR3 | artificial aa | QAWSASTAWV |
| 358. | MU 4-B1 CC x I2C0-scFc VH | artificial aa | QVQLVESGGGVVQPGRSLRLSCAASGFTFSNFGMH WVRQAPGKCLEWVAVIWFDASKTYYAESVKGRFTI SRDTSMNTLYLQMNSLRAEDTAVYYCARATYSTG WSYFDYWGQGTLVTVSS |
| 359. | MU 4-B1 CC x I2C0-scFc VL | artificial aa | SYELTQPPSVSVSPGQTASITCSGDKLGDKYTSWYQ QKPGQSPVLVIYHDAKRPSGIPERFSGSNSGNTATLTI SGTQAMDEADYYCQAWSASTAWVFGCGTKLTVL |
| 360. | MU 4-B1 CC x I2C0-scFc scFv | artificial aa | QVQLVESGGGVVQPGRSLRLSCAASGFTFSNFGMH WVRQAPGKCLEWVAVIWFDASKTYYAESVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVL |
| 361. | MU 4-B1 CC x I2C0-scFc Bispecific molecule | artificial aa | QVQLVESGGGVVQPGRSLRLSCAASGFTFSNFGMH WVRQAPGKCLEWVAVIWFDASKTYYAESVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN |

TABLE 5-continued

Sequence Table

| SEQ ID NO: | Designation | Source | Sequence |
|---|---|---|---|
| | | | YPNWVQQKPGQAPRGLIGGTKFLAPGTPARFSGSLL GGKAALTLSGVQPEDEAEYYCVLWYSNRWVFGGG TKLTVL |
| 362. | MU 4-B1 CC x I2C0-scFc Bispecific HLE molecule | artificial aa | QVQLVESGGGVVQPGRSLRLSCAASGFTFSNFGMH WVRQAPGKCLEWVAVIWFDASKTYYAESVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGGGSDKTHTCPPCPAPELLGGPS VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |
| 363. | MU 4-A8 CC x I2C0-scFc VH CDR1 | artificial aa | NFGMH |
| 364. | MU 4-A8 CC x I2C0-scFc VH CDR2 | artificial aa | VIWFDASKTYYADAVKG |
| 365. | MU 4-A8 CC x I2C0-scFc VH CDR3 | artificial aa | ATYSTGWSYFDY |
| 366. | MU 4-A8 CC x I2C0-scFc VL CDR1 | artificial aa | SGDKLGDKYTS |
| 367. | MU 4-A8 CC x I2C0-scFc VL CDR2 | artificial aa | HDAKRPS |
| 368. | MU 4-A8 CC x I2C0-scFc VL CDR3 | artificial aa | QAWSASTAWV |
| 369. | MU 4-A8 CC x I2C0-scFc VH | artificial aa | QVQLVESGGGVVQPGRSLRLSCAASGFTFSNFGMH WVRQAPGKCLEWVAVIWFDASKTYYADAVKGRFT ISRDTSMNTLYLQMNSLRAEDTAVYYCARATYSTG WSYFDYWGQGTLVTVSS |
| 370. | MU 4-A8 CC x I2C0-scFc VL | artificial aa | SYELTQPPSVSVSPGQTASITCSGDKLGDKYTSWYQ QKPGQSPVLVIYHDAKRPSGIPERFSGSNSGNTATLTI SGTQAMDEADYYCQAWSASTAWVFGCGTKLTVL |
| 371. | MU 4-A8 CC x I2C0-scFc scFv | artificial aa | QVQLVESGGGVVQPGRSLRLSCAASGFTFSNFGMH WVRQAPGKCLEWVAVIWFDASKTYYADAVKGRFT ISRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVL |

TABLE 5-continued

Sequence Table

| SEQ ID NO: | Designation | Source | Sequence |
|---|---|---|---|
| 372. | MU 4-A8 CC x I2C0-scFc Bispecific molecule | artificial aa | QVQLVESGGGVVQPGRSLRLSCAASGFTFSNFGMH WVRQAPGKCLEWVAVIWFDASKTYYADAVKGRFT ISRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVL |
| 373. | MU 4-A8 CC x I2C0-scFc Bispecific HLE molecule | artificial aa | QVQLVESGGGVVQPGRSLRLSCAASGFTFSNFGMH WVRQAPGKCLEWVAVIWFDASKTYYADAVKGRFT ISRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGGGSDKTHTCPPCPAPELLGGPS VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |
| 374. | MU 3-C10 CC x I2C0-scFc VH CDR1 | artificial aa | SYGMH |
| 375. | MU 3-C10 CC x I2C0-scFc VH CDR2 | artificial aa | VIWYSGSNKYYATSVKG |
| 376. | MU 3-C10 CC x I2C0-scFc VH CDR3 | artificial aa | GGYTYGFDY |
| 377. | MU 3-C10 CC x I2C0-scFc VL CDR1 | artificial aa | RASQSINRYLA |
| 378. | MU 3-C10 CC x I2C0-scFc VL CDR2 | artificial aa | TASNRAT |
| 379. | MU 3-C10 CC x I2C0-scFc VL CDR3 | artificial aa | HHYGSSIFT |
| 380. | MU 3-C10 CC x I2C0-scFc VH | artificial aa | QVQLVESGGGVVKPGRSLRLSCAASGFTFSSYGMH WVRQAPGKCLEWVAVIWYSGSNKYYATSVKGRFTI SRDNSKNTLYLQMNNLRAEDTAVYYCARGGYTYG FDYWGQGTLVTVSS |

TABLE 5-continued

Sequence Table

| SEQ ID NO: | Designation | Source | Sequence |
|---|---|---|---|
| 381. | MU 3-C10 CC x I2C0-scFc VL | artificial aa | EIVLTQSPGTLSLSPGERATLSCRASQSINRYLAWYQ QKPGQAPRLLIYTASNRATGIPDRFSGSGSGTDFTLTI SRLEPEDFAVYYCHHYGSSIFTFGCGTKVEIK |
| 382. | MU 3-C10 CC x I2C0-scFc scFv | artificial aa | QVQLVESGGGVVKPGRSLRLSCAASGFTFSSYGMH WVRQAPGKCLEWVAVIWYSGSNKYYATSVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIK |
| 383. | MU 3-C10 CC x I2C0-scFc Bispecific molecule | artificial aa | QVQLVESGGGVVKPGRSLRLSCAASGFTFSSYGMH WVRQAPGKCLEWVAVIWYSGSNKYYATSVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 384. | MU 3-C10 CC x I2C0-scFc Bispecific HLE molecule | artificial aa | QVQLVESGGGVVKPGRSLRLSCAASGFTFSSYGMH WVRQAPGKCLEWVAVIWYSGSNKYYATSVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 385. | MU 2-F7 CC x I2C0-scFc VH CDR1 | artificial aa | SYGMH |
| 386. | MU 2-F7 CC x I2C0-scFc VH CDR2 | artificial aa | VIWFDASNKYYAESVKG |
| 387. | MU 2-F7 CC x I2C0-scFc VH CDR3 | artificial aa | GGYTYGFDY |
| 388. | MU 2-F7 CC x I2C0-scFc VL CDR1 | artificial aa | RASQSINRYLA |

TABLE 5-continued

Sequence Table

| SEQ ID NO: | Designation | Source | Sequence |
|---|---|---|---|
| 389. | MU 2-F7 CC x I2C0-scFc VL CDR2 | artificial aa | TASNRAT |
| 390. | MU 2-F7 CC x I2C0-scFc VL CDR3 | artificial aa | HHYGSSIFT |
| 391. | MU 2-F7 CC x I2C0-scFc VH | artificial aa | QVQLVESGGGLVKPGGSLRLSCAASGFTFSSYGMH WVRQAPGKCLEWVAVIWFDASNKYYAESVKGRFTI SRDNSKNTLYLQMNNLRAEDTAVYYCARGGYTYG FDYWGQGTLVTVSS |
| 392. | MU 2-F7 CC x I2C0-scFc VL | artificial aa | EIVLTQSPGTLSLSPGERATLSCRASQSINRYLAWYQ QKPGQAPRLLIYTASNRATGIPDRFSGSGSGTDFTLTI SRLEPEDFAVYYCHHYGSSIFTFGCGTKVEIK |
| 393. | MU 2-F7 CC x I2C0-scFc scFv | artificial aa | QVQLVESGGGLVKPGGSLRLSCAASGFTFSSYGMH WVRQAPGKCLEWVAVIWFDASNKYYAESVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIK |
| 394. | MU 2-F7 CC x I2C0-scFc Bispecific molecule | artificial aa | QVQLVESGGGLVKPGGSLRLSCAASGFTFSSYGMH WVRQAPGKCLEWVAVIWFDASNKYYAESVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 395. | MU 2-F7 CC x I2C0-scFc Bispecific HLE molecule | artificial aa | QVQLVESGGGLVKPGGSLRLSCAASGFTFSSYGMH WVRQAPGKCLEWVAVIWFDASNKYYAESVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 396. | MU 02-E7 CC x I2C0-scFc VH CDR1 | artificial aa | SYGMH |

TABLE 5-continued

Sequence Table

| SEQ ID NO: | Designation | Source | Sequence |
|---|---|---|---|
| 397. | MU 02-E7 CC x I2C0-scFc VH CDR2 | artificial aa | VIWYTGSNKYYAHSVKG |
| 398. | MU 02-E7 CC x I2C0-scFc VH CDR3 | artificial aa | GAYTYGFDY |
| 399. | MU 02-E7 CC x I2C0-scFc VL CDR1 | artificial aa | RASQSINRYLA |
| 400. | MU 02-E7 CC x I2C0-scFc VL CDR2 | artificial aa | TASNRAT |
| 401. | MU 02-E7 CC x I2C0-scFc VL CDR3 | artificial aa | HHYGSSIFT |
| 402. | MU 02-E7 CC x I2C0-scFc VH | artificial aa | QVQLVESGGGVVQPGGSLRLSCAASGFTFSSYGMH WVRQAPGKCLEWVAVIWYTGSNKYYAHSVKGRFA ISRDNSKNTLYLQMNNLRAEDTAVYYCARGAYTYG FDYWGQGTLVTVSS |
| 403. | MU 02-E7 CC x I2C0-scFc VL | artificial aa | EIVLTQSPGTLSLSPGERATLSCRASQSINRYLAWYQ QKPGQAPRLLIYTASNRATGIPDRFSGSGSGTDFTLTI SRLEPEDFAVYYCHHYGSSIFTFGCGTKVEIK |
| 404. | MU 02-E7 CC x I2C0-scFc scFv | artificial aa | QVQLVESGGGVVQPGGSLRLSCAASGFTFSSYGMH WVRQAPGKCLEWVAVIWYTGSNKYYAHSVKGRFA ISRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIK |
| 405. | MU 02-E7 CC x I2C0-scFc Bispecific molecule | artificial aa | QVQLVESGGGVVQPGGSLRLSCAASGFTFSSYGMH WVRQAPGKCLEWVAVIWYTGSNKYYAHSVKGRFA ISRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 406. | MU 02-E7 CC x I2C0-scFc Bispecific HLE molecule | artificial aa | QVQLVESGGGVVQPGGSLRLSCAASGFTFSSYGMH WVRQAPGKCLEWVAVIWYTGSNKYYAHSVKGRFA ISRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF |

TABLE 5-continued

Sequence Table

| SEQ ID NO: | Designation | Source | Sequence |
|---|---|---|---|
| | | | PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 407. | MU 2-D11 CC x I2C0-scFc VH CDR1 | artificial aa | NHGMH |
| 408. | MU 2-D11 CC x I2C0-scFc VH CDR2 | artificial aa | GIWSDASNKYYAEAVKG |
| 409. | MU 2-D11 CC x I2C0-scFc VH CDR3 | artificial aa | ATYTTGWSYFDY |
| 410. | MU 2-D11 CC x I2C0-scFc VL CDR1 | artificial aa | SGDKLGDKYTS |
| 411. | MU 2-D11 CC x I2C0-scFc VL CDR2 | artificial aa | HDRKRPS |
| 412. | MU 2-D11 CC x I2C0-scFc VL CDR3 | artificial aa | QAYDRSTAWV |
| 413. | MU 2-D11 CC x I2C0-scFc VH | artificial aa | QVQLVESGGGVVQPGRSLRLSCAASGFTFSNHGMH WVRQAPGKCLEWVAGIWSDASNKYYAEAVKGRFT ISRDTSKNTLYLQMNSLRAEDTAVYYCARATYTTG WSYFDYWGQGTLVTVSS |
| 414. | MU 2-D11 CC x I2C0-scFc VL | artificial aa | SYELTQSPSVSVSPGQTASITCSGDKLGDKYTSWYQ QKPGQSPVLVIYHDRKRPSGIPERFSGSNSGNTATLTI SGTQAMDEADYYCQAYDRSTAWVFGCGTKLTVL |
| 415. | MU 2-D11 CC x I2C0-scFc scFv | artificial aa | QVQLVESGGGVVQPGRSLRLSCAASGFTFSNHGMH WVRQAPGKCLEWVAGIWSDASNKYYAEAVKGRFT ISRDTSKNTLYLQMNSLRAEDTAVYYCARATYTTG WSYFDYWGQGTLVTVSSGGGGSGGGGSGGGGSSY ELTQSPSVSVSPGQTASITCSGDKLGDKYTSWYQQK PGQSPVLVIYHDRKRPSGIPERFSGSNSGNTATLTISG TQAMDEADYYCQAYDRSTAWVFGCGTKLTVL |
| 416. | MU 2-D11 CC x I2C0-scFc Bispecific molecule | artificial aa | QVQLVESGGGVVQPGRSLRLSCAASGFTFSNHGMH WVRQAPGKCLEWVAGIWSDASNKYYAEAVKGRFT ISRDTSKNTLYLQMNSLRAEDTAVYYCARATYTTG WSYFDYWGQGTLVTVSSGGGGSGGGGSGGGGSSY ELTQSPSVSVSPGQTASITCSGDKLGDKYTSWYQQK PGQSPVLVIYHDRKRPSGIPERFSGSNSGNTATLTISG TQAMDEADYYCQAYDRSTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLCGSSTGAVTSGN YPNWVQQKPGQAPRGLIGGTKFLAPGTPARFSGSLL GGKAALTLSGVQPEDEAEYYCVLWYSNRWVFGGG TKLTVL |
| 417. | MU 2-D11 CC x I2C0-scFc Bispecific HLE molecule | artificial aa | QVQLVESGGGVVQPGRSLRLSCAASGFTFSNHGMH WVRQAPGKCLEWVAGIWSDASNKYYAEAVKGRFT ISRDTSKNTLYLQMNSLRAEDTAVYYCARATYTTG WSYFDYWGQGTLVTVSSGGGGSGGGGSGGGGSSY ELTQSPSVSVSPGQTASITCSGDKLGDKYTSWYQQK PGQSPVLVIYHDRKRPSGIPERFSGSNSGNTATLTISG TQAMDEADYYCQAYDRSTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG |

TABLE 5-continued

Sequence Table

| SEQ ID NO: | Designation | Source | Sequence |
|---|---|---|---|
| | | | GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGGGSDKTHTCPPCPAPELLGGPS VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |
| 418. | MU 2-C2 CC x I2C0-scFc VH CDR1 | artificial aa | NHGMH |
| 419. | MU 2-C2 CC x I2C0-scFc VH CDR2 | artificial aa | GIWSEGSNKYYADAVKG |
| 420. | MU 2-C2 CC x I2C0-scFc VH CDR3 | artificial aa | ATYTTGWSYFDY |
| 421. | MU 2-C2 CC x I2C0-scFc VL CDR1 | artificial aa | SGDKLGDKYAS |
| 422. | MU 2-C2 CC x I2C0-scFc VL CDR2 | artificial aa | QDAKRPS |
| 423. | MU 2-C2 CC x I2C0-scFc VL CDR3 | artificial aa | QAFHQSTWV |
| 424. | MU 2-C2 CC x I2C0-scFc VH | artificial aa | QVQLVESGGGVVQPGRSLRLSCAASGFTFSNHGMH WVRQAPGKCLEWVAGIWSEGSNKYYADAVKGRFT ISRDNSKNTLYLQMNSLRAEDTAVYYCARATYTTG WSYFDYWGQGTLVTVSS |
| 425. | MU 2-C2 CC x I2C0-scFc VL | artificial aa | SYELTQPPSVSVSPGQTASITCSGDKLGDKYASWYQ QKSGQSPVLVIYQDAKRPSGIPERFSGSNSGNTATLTI SGTQAMDEADYYCQAFHQSTWVFGCGTQLTVL |
| 426. | MU 2-C2 CC x I2C0-scFc scFv | artificial aa | QVQLVESGGGVVQPGRSLRLSCAASGFTFSNHGMH WVRQAPGKCLEWVAGIWSEGSNKYYADAVKGRFT ISRDNSKNTLYLQMNSLRAEDTAVYYCARATYTTG WSYFDYWGQGTLVTVSSGGGGSGGGGSGGGGSSY ELTQPPSVSVSPGQTASITCSGDKLGDKYASWYQQK SGQSPVLVIYQDAKRPSGIPERFSGSNSGNTATLTISG TQAMDEADYYCQAFHQSTWVFGCGTQLTVL |
| 427. | MU 2-C2 CC x I2C0-scFc Bispecific molecule | artificial aa | QVQLVESGGGVVQPGRSLRLSCAASGFTFSNHGMH WVRQAPGKCLEWVAGIWSEGSNKYYADAVKGRFT ISRDNSKNTLYLQMNSLRAEDTAVYYCARATYTTG WSYFDYWGQGTLVTVSSGGGGSGGGGSGGGGSSY ELTQPPSVSVSPGQTASITCSGDKLGDKYASWYQQK SGQSPVLVIYQDAKRPSGIPERFSGSNSGNTATLTISG TQAMDEADYYCQAFHQSTWVFGCGTQLTVLSGGG GSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVL |

TABLE 5-continued

Sequence Table

| SEQ ID NO: | Designation | Source | Sequence |
|---|---|---|---|
| 428. | MU 2-C2 CC x I2C0-scFc Bispecific HLE molecule | artificial aa | QVQLVESGGGVVQPGRSLRLSCAASGFTFSNHGMH WVRQAPGKCLEWVAGIWSEGSNKYYADAVKGRFT ISRDNSKNTLYLQMNSLRAEDTAVYYCARATYTTG WSYFDYWGQGTLVTVSSGGGGSGGGGSGGGGSSY ELTQPPSVSVSPGQTASITCSGDKLGDKYASWYQQK SGQSPVLVIYQDAKRPSGIPERFSGSNSGNTATLTISG TQAMDEADYYCQAFHQSTWVFGCGTQLTVLSGGG GSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGGGSDKTHTCPPCPAPELLGGPS VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |
| 429. | MU 2-A3 CC x I2C0-scFc VH CDR1 | artificial aa | SFGMH |
| 430. | MU 2-A3 CC x I2C0-scFc VH CDR2 | artificial aa | VIWFDASNKYYAESVKG |
| 431. | MU 2-A3 CC x I2C0-scFc VH CDR3 | artificial aa | GGYTYGFDY |
| 432. | MU 2-A3 CC x I2C0-scFc VL CDR1 | artificial aa | RASQAINRYLA |
| 433. | MU 2-A3 CC x I2C0-scFc VL CDR2 | artificial aa | GASSRAT |
| 434. | MU 2-A3 CC x I2C0-scFc VL CDR3 | artificial aa | QHYGSSIFT |
| 435. | MU 2-A3 CC x I2C0-scFc VH | artificial aa | QVQLVESGGGVVQPGRSLRLSCAASGFTFSSFGMH WVRQAPGKCLEWVAVIWFDASNKYYAESVKGRFTI SRDNSKNTLYLQMNSLRAEDTAVYYCARGGYTYGF DYWGQGTLVTVSS |
| 436. | MU 2-A3 CC x I2C0-scFc | artificial aa | EIVLTQSPGTLSVSPGERATLSCRASQAINRYLAWYQ QKPGQAPRLLIYGASSRATGIPDRFSGSGSGTDFTLTI SRLEPEDFAVYYCQHYGSSIFTFGCGTKVEIK |
| 437. | MU 2-A3 CC x I2C0-scFc scFv VL | artificial aa | QVQLVESGGGVVQPGRSLRLSCAASGFTFSSFGMH WVRQAPGKCLEWVAVIWFDASNKYYAESVKGRFTI SRDNSKNTLYLQMNSLRAEDTAVYYCARGGYTYGF DYWGQGTLVTVSSGGGGSGGGGSGGGGSEIVLTQS PGTLSVSPGERATLSCRASQAINRYLAWYQQKPGQA PRLLIYGASSRATGIPDRFSGSGSGTDFTLTISRLEPED FAVYYCQHYGSSIFTFGCGTKVEIK |
| 438. | MU 2-A3 CC x I2C0-scFc Bispecific molecule | artificial aa | QVQLVESGGGVVQPGRSLRLSCAASGFTFSSFGMH WVRQAPGKCLEWVAVIWFDASNKYYAESVKGRFTI SRDNSKNTLYLQMNSLRAEDTAVYYCARGGYTYGF DYWGQGTLVTVSSGGGGSGGGGSGGGGSEIVLTQS PGTLSVSPGERATLSCRASQAINRYLAWYQQKPGQA |

TABLE 5-continued

Sequence Table

| SEQ ID NO: | Designation | Source | Sequence |
|---|---|---|---|
| | | | PRLLIYGASSRATGIPDRFSGSGSGTDFTLTISRLEPED FAVYYCQHYGSSIFTFGCGTKVEIKSGGGGSEVQLV ESGGGLVQPGGSLKLSCAASGFTFNKYAMNWVRQA PGKGLEWVARIRSKYNNYATYYADSVKDRFTISRD DSKNTAYLQMNNLKTEDTAVYYCVRHGNFGNSYIS YWAYWGQGTLVTVSSGGGGSGGGGSGGGGSQTVV TQEPSLTVSPGGTVTLTCGSSTGAVTSGNYPNWVQQ KPGQAPRGLIGGTKFLAPGTPARFSGSLLGGKAALT LSGVQPEDEAEYYCVLWYSNRWVFGGGTKLTVL |
| 439. | MU 2-A3 CC x I2C0-scFc Bispecific HLE molecule | artificial aa | QVQLVESGGGVVQPGRSLRLSCAASGFTFSSFGMH WVRQAPGKCLEWVAVIWFDASNKYYAESVKGRFTI SRDNSKNTLYLQMNSLRAEDTAVYYCARGGYTYGF DYWGQGTLVTVSSGGGGSGGGGSGGGGSEIVLTQS PGTLSVSPGERATLSCRASQAINRYLAWYQQKPGQA PRLLIYGASSRATGIPDRFSGSGSGTDFTLTISRLEPED FAVYYCQHYGSSIFTFGCGTKVEIKSGGGGSEVQLV ESGGGLVQPGGSLKLSCAASGFTFNKYAMNWVRQA PGKGLEWVARIRSKYNNYATYYADSVKDRFTISRD DSKNTAYLQMNNLKTEDTAVYYCVRHGNFGNSYIS YWAYWGQGTLVTVSSGGGGSGGGGSGGGGSQTVV TQEPSLTVSPGGTVTLTCGSSTGAVTSGNYPNWVQQ KPGQAPRGLIGGTKFLAPGTPARFSGSLLGGKAALT LSGVQPEDEAEYYCVLWYSNRWVFGGGTKLTVLG GGGDKTHTCPPCPAPELLGGPSVFLFPPKPKDTLMIS RTPEVTCVVVDVSHEDPEVKFNWYVDGVEVHNAK TKPCEEQYGSTYRCVSVLTVLHQDWLNGKEYKCKV SNKALPAPIEKTISKAKGQPREPQVYTLPPSREEMTK NQVSLTCLVKGFYPSDIAVEWESNGQPENNYKTTPP VLDSDGSFFLYSKLTVDKSRWQQGNVFSCSVMHEA LHNHYTQKSLSLSPGKGGGGSGGGGSGGGGSGGGG SGGGGSGGGGSDKTHTCPPCPAPELLGGPSVFLFPPK PKDTLMISRTPEVTCVVVDVSHEDPEVKFNWYVDG VEVHNAKTKPCEEQYGSTYRCVSVLTVLHQDWLNG KEYKCKVSNKALPAPIEKTISKAKGQPREPQVYTLPP SREEMTKNQVSLTCLVKGFYPSDIAVEWESNGQPEN NYKTTPPVLDSDGSFFLYSKLTVDKSRWQQGNVFSC SVMHEALHNHYTQKSLSLSPGK |
| 440. | MU 1-H2 CC x I2C0-scFc VH CDR1 | artificial aa | SYGMH |
| 441. | MU 1-H2 CC x I2C0-scFc VH CDR2 | artificial aa | VIWYDASNKYYATSVKG |
| 442. | MU 1-H2 CC x I2C0-scFc VH CDR3 | artificial aa | GGYTYGFDY |
| 443. | MU 1-H2 CC x I2C0-scFc VL CDR1 | artificial aa | RASQSINRYLA |
| 444. | MU 1-H2 CC x I2C0-scFc VL CDR2 | artificial aa | TASNRAT |
| 445. | MU 1-H2 CC x I2C0-scFc VL CDR3 | artificial aa | HHYGSSIFT |
| 446. | MU 1-H2 CC x I2C0-scFc VH | artificial aa | QVQLVESGGGLVKPGGSLRLSCAASGFTFSSYGMH WVRQAPGKCLEWVAVIWYDASNKYYATSVKGRFT ISRDNSKNTLYLQMNNLRAEDTAVYYCARGGYTYG FDYWGQGTLVTVSS |
| 447. | MU 1-H2 CC x I2C0-scFc VL | artificial aa | EIVLTQSPGTLSLSPGERATLSCRASQSINRYLAWYQ QKPGQAPRLLIYTASNRATGIPDRFSGSGSGTDFTLTI SRLEPEDFAVYYCHHYGSSIFTFGCGTKVEIK |
| 448. | MU 1-H2 CC x I2C0-scFc scFv | artificial aa | QVQLVESGGGLVKPGGSLRLSCAASGFTFSSYGMH WVRQAPGKCLEWVAVIWYDASNKYYATSVKGRFT ISRDNSKNTLYLQMNNLRAEDTAVYYCARGGYTYG |

TABLE 5-continued

Sequence Table

| SEQ ID NO: | Designation | Source | Sequence |
|---|---|---|---|
| | | | FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIK |
| 449. | MU 1-H2 CC x I2C0-scFc Bispecific molecule | artificial aa | QVQLVESGGGLVKPGGSLRLSCAASGFTFSSYGMH WVRQAPGKCLEWVAVIWYDASNKYYATSVKGRFT ISRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 450. | MU 1-H2 CC x I2C0-scFc Bispecific HLE molecule | artificial aa | QVQLVESGGGLVKPGGSLRLSCAASGFTFSSYGMH WVRQAPGKCLEWVAVIWYDASNKYYATSVKGRFT ISRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 451. | MU 1-E9 CC x I2C0-scFc VH CDR1 | artificial aa | SYGMH |
| 452. | MU 1-E9 CC x I2C0-scFc VH CDR2 | artificial aa | VIWFHGSNKYYAESVKG |
| 453. | MU 1-E9 CC x I2C0-scFc VH CDR3 | artificial aa | GAYTYGFDY |
| 454. | MU 1-E9 CC x I2C0-scFc VL CDR1 | artificial aa | RASQSINRYLA |
| 455. | MU 1-E9 CC x I2C0-scFc VL CDR2 | artificial aa | TASNRAT |
| 456. | MU 1-E9 CC x I2C0-scFc VL CDR3 | artificial aa | HHYGSSIFT |

TABLE 5-continued

Sequence Table

| SEQ ID NO: | Designation | Source | Sequence |
|---|---|---|---|
| 457. | MU 1-E9 CC x I2C0-scFc VH | artificial aa | QVQLVESGGGVVKPGRSLRLSCAASGFTFSSYGMH WVRQAPGKCLEWVAVIWFHGSNKYYAESVKGRFTI SRDNSKNTLYLQMNNLRAEDTAVYYCARGAYTYG FDYWGQGTLVTVSS |
| 458. | MU 1-E9 CC x I2C0-scFc VL | artificial aa | EIVLTQSPGTLSLSPGERATLSCRASQSINRYLAWYQ QKPGQAPRLLIYTASNRATGIPDRFSGSGSGTDFTLTI SRLEPEDFAVYYCHHYGSSIFTFGCGTKVEIK |
| 459. | MU 1-E9 CC x I2C0-scFc scFv | artificial aa | QVQLVESGGGVVKPGRSLRLSCAASGFTFSSYGMH WVRQAPGKCLEWVAVIWFHGSNKYYAESVKGRFTI SRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIK |
| 460. | MU 1-E9 CC x I2C0-scFc Bispecific molecule | artificial aa | QVQLVESGGGVVKPGRSLRLSCAASGFTFSSYGMH WVRQAPGKCLEWVAVIWFHGSNKYYAESVKGRFTI SRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 461. | MU 1-E9 CC x I2C0-scFc Bispecific HLE molecule | artificial aa | QVQLVESGGGVVKPGRSLRLSCAASGFTFSSYGMH WVRQAPGKCLEWVAVIWFHGSNKYYAESVKGRFTI SRDNSKNTLYLQMNNLRAEDTAVYYCARGAYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 462. | MU 1-B10 CC x I2C0-scFc VH CDR1 | artificial aa | NFGMH |
| 463. | MU 1-B10 CC x I2C0-scFc VH CDR2 | artificial aa | VIWFDASKTYYAEAVKG |
| 464. | MU 1-B10 CC x I2C0-scFc VH CDR3 | artificial aa | ATYSTGWSYFDY |

TABLE 5-continued

Sequence Table

| SEQ ID NO: | Designation | Source | Sequence |
|---|---|---|---|
| 465. | MU 1-B10 CC x I2C0-scFc VL CDR1 | artificial aa | SGDKLGDKYTS |
| 466. | MU 1-B10 CC x I2C0-scFc VL CDR2 | artificial aa | HDAKRPS |
| 467. | MU 1-B10 CC x I2C0-scFc VL CDR3 | artificial aa | QAWSASTAWV |
| 468. | MU 1-B10 CC x I2C0-scFc VH | artificial aa | QVQLVESGGGVVQPGRSLRLSCAASGFTFSNFGMH WVRQAPGKCLEWVAVIWFDASKTYYAEAVKGRFTI SRDTSMNTLYLQMNSLRAEDTAVYYCARATYSTG WSYFDYWGQGTLVTVSS |
| 469. | MU 1-B10 CC x I2C0-scFc VL | artificial aa | SYELTQPPSVSVSPGQTASITCSGDKLGDKYTSWYQ QKPGQSPVLVIYHDAKRPSGIPERFSGSNSGNTATLTI SGTQAMDEADYYCQAWSASTAWVFGCGTKLTVL |
| 470. | MU 1-B10 CC x I2C0-scFc scFv | artificial aa | QVQLVESGGGVVQPGRSLRLSCAASGFTFSNFGMH WVRQAPGKCLEWVAVIWFDASKTYYAEAVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVL |
| 471. | MU 1-B10 CC x I2C0-scFc Bispecific molecule | artificial aa | QVQLVESGGGVVQPGRSLRLSCAASGFTFSNFGMH WVRQAPGKCLEWVAVIWFDASKTYYAEAVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVL |
| 472. | MU 1-B10 CC x I2C0-scFc Bispecific HLE molecule | artificial aa | QVQLVESGGGVVQPGRSLRLSCAASGFTFSNFGMH WVRQAPGKCLEWVAVIWFDASKTYYAEAVKGRFTI SRDTSMNTLYLQMNSLRAEDTAVYYCARATYSTG WSYFDYWGQGTLVTVSSGGGGSGGGGSGGGGSSY ELTQPPSVSVSPGQTASITCSGDKLGDKYTSWYQQK PGQSPVLVIYHDAKRPSGIPERFSGSNSGNTATLTISG TQAMDEADYYCQAWSASTAWVFGCGTKLTVLSGG GGSEVQLVESGGGLVQPGGSLKLSCAASGFTFNKYA MNWVRQAPGKGLEWVARIRSKYNNYATYYADSVK DRFTISRDDSKNTAYLQMNNLKTEDTAVYYCVRHG NFGNSYISYWAYWGQGTLVTVSSGGGGSGGGGSGG GGSQTVVTQEPSLTVSPGGTVTLTCGSSTGAVTSGN YPNWVQQKPGQAPRGLIGGTKFLAPGTPARFSGSLL GGKAALTLSGVQPEDEAEYYCVLWYSNRWVFGGG TKLTVLGGGGDKTHTCPPCPAPELLGGPSVFLFPPKP KDTLMISRTPEVTCVVVDVSHEDPEVKFNWYVDGV EVHNAKTKPCEEQYGSTYRCVSVLTVLHQDWLNGK EYKCKVSNKALPAPIEKTISKAKGQPREPQVYTLPPS REEMTKNQVSLTCLVKGFYPSDIAVEWESNGQPEN NYKTTPPVLDSDGSFFLYSKLTVDKSRWQQGNVFSC SVMHEALHNHYTQKSLSLSPGKGGGGSGGGGSGGG GSGGGGSGGGGSGGGGSDKTHTCPPCPAPELLGGPS VFLFPPKPKDTLMISRTPEVTCVVVDVSHEDPEVKFN WYVDGVEVHNAKTKPCEEQYGSTYRCVSVLTVLH QDWLNGKEYKCKVSNKALPAPIEKTISKAKGQPREP QVYTLPPSREEMTKNQVSLTCLVKGFYPSDIAVEWE SNGQPENNYKTTPPVLDSDGSFFLYSKLTVDKSRWQ QGNVFSCSVMHEALHNHYTQKSLSLSPGK |

TABLE 5-continued

Sequence Table

| SEQ ID NO: | Designation | Source | Sequence |
|---|---|---|---|
| 473. | MU 1-B6 CC x I2C0-scFc VH CDR1 | artificial aa | GYYWS |
| 474. | MU 1-B6 CC x I2C0-scFc VH CDR2 | artificial aa | DIDYSGSTKYNPSLKS |
| 475. | MU 1-B6 CC x I2C0-scFc VH CDR3 | artificial aa | KKYSTVWSYFDY |
| 476. | MU 1-B6 CC x I2C0-scFc VL CDR1 | artificial aa | SGDKLGDKYAN |
| 477. | MU 1-B6 CC x I2C0-scFc VL CDR2 | artificial aa | HDNKRPS |
| 478. | MU 1-B6 CC x I2C0-scFc VL CDR3 | artificial aa | QAYGISSAV |
| 479. | MU 1-B6 CC x I2C0-scFc VH | artificial aa | QVQLQQWGAGLLKPSETLSLTCAVYGGSFSGYYWS WIRQPPGKCLEWIGDIDYSGSTKYNPSLKSRVTISLD TSKNQFSLKLNSVTAADTAVYFCARKKYSTVWSYF DYWGQGTLVTVSS |
| 480. | MU 1-B6 CC x I2C0-scFc VL | artificial aa | SYELTQPASASVSPGQTASITCSGDKLGDKYANWYQ QKPGQSPILVIYHDNKRPSGIPERFSGSNSGNTATLTI SGTQAMDEADYYCQAYGISSAVFGCGTKLTVL |
| 481. | MU 1-B6 CC x I2C0-scFc scFv | artificial aa | QVQLQQWGAGLLKPSETLSLTCAVYGGSFSGYYWS WIRQPPGKCLEWIGDIDYSGSTKYNPSLKSRVTISLD TSKNQFSLKLNSVTAADTAVYFCARKKYSTVWSYF DYWGQGTLVTVSSGGGGSGGGGSGGGGSSYELTQP ASASVSPGQTASITCSGDKLGDKYANWYQQKPGQS PILVIYHDNKRPSGIPERFSGSNSGNTATLTISGTQAM DEADYYCQAYGISSAVFGCGTKLTVL |
| 482. | MU 1-B6 CC x I2C0-scFc Bispecific molecule | artificial aa | QVQLQQWGAGLLKPSETLSLTCAVYGGSFSGYYWS WIRQPPGKCLEWIGDIDYSGSTKYNPSLKSRVTISLD TSKNQFSLKLNSVTAADTAVYFCARKKYSTVWSYF DYWGQGTLVTVSSGGGGSGGGGSGGGGSSYELTQP ASASVSPGQTASITCSGDKLGDKYANWYQQKPGQS PILVIYHDNKRPSGIPERFSGSNSGNTATLTISGTQAM DEADYYCQAYGISSAVFGCGTKLTVLSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 483. | MU 1-B6 CC x I2C0-scFc Bispecific HLE molecule | artificial aa | QVQLQQWGAGLLKPSETLSLTCAVYGGSFSGYYWS WIRQPPGKCLEWIGDIDYSGSTKYNPSLKSRVTISLD TSKNQFSLKLNSVTAADTAVYFCARKKYSTVWSYF DYWGQGTLVTVSSGGGGSGGGGSGGGGSSYELTQP ASASVSPGQTASITCSGDKLGDKYANWYQQKPGQS PILVIYHDNKRPSGIPERFSGSNSGNTATLTISGTQAM DEADYYCQAYGISSAVFGCGTKLTVLSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM |

TABLE 5-continued

Sequence Table

| SEQ ID NO: | Designation | Source | Sequence |
|---|---|---|---|
| | | | TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 484. | MU 1-A6 CC x I2C0-scFc VH CDR1 | artificial aa | GYYWS |
| 485. | MU 1-A6 CC x I2C0-scFc VH CDR2 | artificial aa | DIDQSGSTKYNPSLKS |
| 486. | MU 1-A6 CC x I2C0-scFc VH CDR3 | artificial aa | KKYSTVWSYFDY |
| 487. | MU 1-A6 CC x I2C0-scFc VL CDR1 | artificial aa | SGDKLGDKYAS |
| 488. | MU 1-A6 CC x I2C0-scFc VL CDR2 | artificial aa | QDRKRPS |
| 489. | MU 1-A6 CC x I2C0-scFc VL CDR3 | artificial aa | QAWGSSAAV |
| 490. | MU 1-A6 CC x I2C0-scFc VH | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSS |
| 491. | MU 1-A6 CC x I2C0-scFc VL | artificial aa | SYELTQPSSVSVPPGQTASITCSGDKLGDKYASWYQ QKPGQSPVLVIYQDRKRPSGVPERFSGSNSGNTATLT ISGTQAMDEADYYCQAWGSSAAVFGCGTKLTVL |
| 492. | MU 1-A6 CC x I2C0-scFc scFv | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSSGGGGSGGGGSGGGGSSYELTQP SSVSVPPGQTASITCSGDKLGDKYASWYQQKPGQSP VLVIYQDRKRPSGVPERFSGSNSGNTATLTISGTQAM DEADYYCQAWGSSAAVFGCGTKLTVL |
| 493. | MU 1-A6 CC x I2C0-scFc Bispecific molecule | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSSGGGGSGGGGSGGGGSSYELTQP SSVSVPPGQTASITCSGDKLGDKYASWYQQKPGQSP VLVIYQDRKRPSGVPERFSGSNSGNTATLTISGTQAM DEADYYCQAWGSSAAVFGCGTKLTVLSGGGGSEV QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 494. | MU 1-A6 CC x I2C0-scFc Bispecific HLE molecule | artificial aa | QVQLQQWGAGLLKPSETLSLTCAVYGGSFSGYYWS WIRQPPGKCLEWIGDIDQSGSTKYNPSLKSRVTISLD TSKNQFSLKLNSVTAADTAVYFCARKKYSTVWSYF DYWGQGTLVTVSSGGGGSGGGGSGGGGSSYELTQP SSVSVPPGQTASITCSGDKLGDKYASWYQQKPGQSP VLVIYQDRKRPSGVPERFSGSNSGNTATLTISGTQAM DEADYYCQAWGSSAAVFGCGTKLTVLSGGGGSEV |

TABLE 5-continued

Sequence Table

| SEQ ID NO: | Designation | Source | Sequence |
|---|---|---|---|
| | | | QLVESGGGLVQPGGSLKLSCAASGFTFNKYAMNWV RQAPGKGLEWVARIRSKYNNYATYYADSVKDRFTI SRDDSKNTAYLQMNNLKTEDTAVYYCVRHGNFGN SYISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 495. | MU 0-F9 CC x I2C0-scFc VH CDR1 | artificial aa | SFGMH |
| 496. | MU 0-F9 CC x I2C0-scFc VH CDR2 | artificial aa | VIWYTGSNKYYASSVKG |
| 497. | MU 0-F9 CC x I2C0-scFc VH CDR3 | artificial aa | GGYTYGFDY |
| 498. | MU 0-F9 CC x I2C0-scFc VL CDR1 | artificial aa | RASQSINRYLA |
| 499. | MU 0-F9 CC x I2C0-scFc VL CDR2 | artificial aa | TASNRAT |
| 500. | MU 0-F9 CC x I2C0-scFc VL CDR3 | artificial aa | HHYGSSIFT |
| 501. | MU 0-F9 CC x I2C0-scFc VH | artificial aa | QVQLVESGGGLVKPGGSLRLSCAASGFTFSSFGMH WVRQAPGKCLEWVAVIWYTGSNKYYASSVKGRFTI SRDNSKNTLYLQMNNLRAEDTAVYYCARGGYTYG FDYWGQGTLVTVSS |
| 502. | MU 0-F9 CC x I2C0-scFc VL | artificial aa | EIVLTQSPGTLSLSPGERATLSCRASQSINRYLAWYQ QKPGQAPRLLIYTASNRATGIPDRFSGSGSGTDFTLTI SRLEPEDFAVYYCHHYGSSIFTFGCGTKVEIK |
| 503. | MU 0-F9 CC x I2C0-scFc scFv | artificial aa | QVQLVESGGGLVKPGGSLRLSCAASGFTFSSFGMH WVRQAPGKCLEWVAVIWYTGSNKYYASSVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIK |
| 504. | MU 0-F9 CC x I2C0-scFc Bispecific molecule | artificial aa | QVQLVESGGGLVKPGGSLRLSCAASGFTFSSFGMH WVRQAPGKCLEWVAVIWYTGSNKYYASSVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW |

TABLE 5-continued

Sequence Table

| SEQ ID NO: | Designation | Source | Sequence |
|---|---|---|---|
| | | | VQQKPGQAPRGLIGGTKFLAPGTPARFSGSLLGGKA ALTLSGVQPEDEAEYYCVLWYSNRWVFGGGTKLTV L |
| 505. | MU 0-F9 CC x I2C0-scFc Bispecific HLE molecule | artificial aa | QVQLVESGGGLVKPGGSLRLSCAASGFTFSSFGMH WVRQAPGKCLEWVAVIWYTGSNKYYASSVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 506. | MU 0-F6 CC x I2C0-scFc VH CDR1 | artificial aa | SYGMH |
| 507. | MU 0-F6 CC x I2C0-scFc VH CDR2 | artificial aa | VIWFDASNKYYAESVKG |
| 508. | MU 0-F6 CC x I2C0-scFc VH CDR3 | artificial aa | GGYTYGFDY |
| 509. | MU 0-F6 CC x I2C0-scFc VL CDR1 | artificial aa | RASQSINRYLA |
| 510. | MU 0-F6 CC x I2C0-scFc VL CDR2 | artificial aa | TASNRAT |
| 511. | MU 0-F6 CC x I2C0-scFc VL CDR3 | artificial aa | HHYGSSIFT |
| 512. | MU 0-F6 CC x I2C0-scFc VH | artificial aa | QVQLVESGGGLVKPGRSLRLSCAASGFTFSSYGMH WVRQAPGKCLEWVAVIWFDASNKYYAESVKGRFTI SRDNSKNTLYLQMNNLRAEDTAVYYCARGGYTYG FDYWGQGTLVTVSS |
| 513. | MU 0-F6 CC x I2C0-scFc VL | artificial aa | EIVLTQSPGTLSLSPGERATLSCRASQSINRYLAWYQ QKPGQAPRLLIYTASNRATGIPDRFSGSGSGTDFTLTI SRLEPEDFAVYYCHHYGSSIFTFGCGTKVEIK |
| 514. | MU 0-F6 CC x I2C0-scFc scFv | artificial aa | QVQLVESGGGLVKPGRSLRLSCAASGFTFSSYGMH WVRQAPGKCLEWVAVIWFDASNKYYAESVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIK |

TABLE 5-continued

Sequence Table

| SEQ ID NO: | Designation | Source | Sequence |
|---|---|---|---|
| 515. | MU 0-F6 CC x I2C0-scFc Bispecific molecule | artificial aa | QVQLVESGGGLVKPGRSLRLSCAASGFTFSSYGMH WVRQAPGKCLEWVAVIWFDASNKYYAESVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 516. | MU 0-F6 CC x I2C0-scFc Bispecific HLE molecule | artificial aa | QVQLVESGGGLVKPGRSLRLSCAASGFTFSSYGMH WVRQAPGKCLEWVAVIWFDASNKYYAESVKGRFTI SRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 517. | MU 0-E5 CC x I2C0-scFc VH CDR1 | artificial aa | SYGMH |
| 518. | MU 0-E5 CC x I2C0-scFc VH CDR2 | artificial aa | VIWYDASNKYYATSVKG |
| 519. | MU 0-E5 CC x I2C0-scFc VH CDR3 | artificial aa | GGYTYGFDY |
| 520. | MU 0-E5 CC x I2C0-scFc VL CDR1 | artificial aa | RASQSINRYLA |
| 521. | MU 0-E5 CC x I2C0-scFc VL CDR2 | artificial aa | TASNRAT |
| 522. | MU 0-E5 CC x I2C0-scFc VL CDR3 | artificial aa | HHYGSSIFT |
| 523. | MU 0-E5 CC x I2C0-scFc VH | artificial aa | QVQLVESGGGVVKPGRSLRLSCAASGFTFSSYGMH WVRQAPGKCLEWVAVIWYDASNKYYATSVKGRFT ISRDNSKNTLYLQMNNLRAEDTAVYYCARGGYTYG FDYWGQGTLVTVSS |

TABLE 5-continued

Sequence Table

| SEQ ID NO: | Designation | Source | Sequence |
|---|---|---|---|
| 524. | MU 0-E5 CC x I2C0-scFc VL | artificial aa | EIVLTQSPGTLSLSPGERATLSCRASQSINRYLAWYQ QKPGQAPRLLIYTASNRATGIPDRFSGSGSGTDFTLTI SRLEPEDFAVYYCHHYGSSIFTFGCGTKVEIK |
| 525. | MU 0-E5 CC x I2C0-scFc scFv | artificial aa | QVQLVESGGGVVKPGRSLRLSCAASGFTFSSYGMH WVRQAPGKCLEWVAVIWYDASNKYYATSVKGRFT ISRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIK |
| 526. | MU 0-E5 CC x I2C0-scFc Bispecific molecule | artificial aa | QVQLVESGGGVVKPGRSLRLSCAASGFTFSSYGMH WVRQAPGKCLEWVAVIWYDASNKYYATSVKGRFT ISRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV L |
| 527. | MU 0-E5 CC x I2C0-scFc Bispecific HLE molecule | artificial aa | QVQLVESGGGVVKPGRSLRLSCAASGFTFSSYGMH WVRQAPGKCLEWVAVIWYDASNKYYATSVKGRFT ISRDNSKNTLYLQMNNLRAEDTAVYYCARGGYTYG FDYWGQGTLVTVSSGGGGSGGGGSGGGGSEIVLTQ SPGTLSLSPGERATLSCRASQSINRYLAWYQQKPGQ APRLLIYTASNRATGIPDRFSGSGSGTDFTLTISRLEP EDFAVYYCHHYGSSIFTFGCGTKVEIKSGGGGSEVQ LVESGGGLVQPGGSLKLSCAASGFTFNKYAMNWVR QAPGKGLEWVARIRSKYNNYATYYADSVKDRFTIS RDDSKNTAYLQMNNLKTEDTAVYYCVRHGNFGNS YISYWAYWGQGTLVTVSSGGGGSGGGGSGGGGSQ TVVTQEPSLTVSPGGTVTLTCGSSTGAVTSGNYPNW VQQKPGQAPRGLIGGTKFLAPGTPARFSGSLLGGKA ALTLSGVQPEDEAEYYCVLWYSNRWVFGGGTKLTV LGGGGDKTHTCPPCPAPELLGGPSVFLFPPKPKDTL MISRTPEVTCVVVDVSHEDPEVKFNWYVDGVEVHN AKTKPCEEQYGSTYRCVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMH EALHNHYTQKSLSLSPGKGGGGSGGGGSGGGGSGG GGSGGGGSGGGGSDKTHTCPPCPAPELLGGPSVFLF PPKPKDTLMISRTPEVTCVVVDVSHEDPEVKFNWYV DGVEVHNAKTKPCEEQYGSTYRCVSVLTVLHQDWL NGKEYKCKVSNKALPAPIEKTISKAKGQPREPQVYT LPPSREEMTKNQVSLTCLVKGFYPSDIAVEWESNGQ PENNYKTTPPVLDSDGSFFLYSKLTVDKSRWQQGN VFSCSVMHEALHNHYTQKSLSLSPGK |
| 528. | MUC17 epitope E2 | artificial aa | EVVSSIDIGPPETISAQMELTVTVSVKFTEELKNHSS QEFQEFKQTFTEQMNIVYSGIPEYVGVNITKLRLGSV VVEHDVLLRTKYTPEYKTVLDNATEVVKEKITKVTT QQIMINDICSDMMCF |
| 529. | MUC17 epitope E2 (N-term shortened) | artificial aa | SAQMELTVTVSVKFTEELKNHSSQEFQEFKQTFTE QMNIVYSGIPEYVGVNITKLRLGSVVVEHDVLLRTK YTPEYKTVLDNATEVVKEKITKVTTQQIMINDICS |
| 530. | MUC17 epitope 5A (comprises part of E2) | artificial aa | RTTTCFGDGCQNTASRCKNGGTWDGLKCQCPNLYY GELCEEVVSSIDIGPPETISAQMELTVTVSVKFTEEL KNHSSQEFQEFKQTFTEQMNIVYSGIPEYVGVNITKL RLG |

TABLE 5-continued

Sequence Table

| SEQ ID NO: | Designation | Source | Sequence |
|---|---|---|---|
| 531. | MUC17 epitope 5B (comprises part of E2) | artificial aa | SVVVEHDVLLRTKYTPEYKTVLDNATEVVKEKITK VTTQQIMINDICSDMMCFNTTGTQVQNITVTQYDPE EDCRKMAKEYGDYFVVEYRDQKPYCISPCEPGFSVS KNCNLGKCQMSLSGPQCLCVTTETHWYSGETCNQG TQKS |
| 532. | MUC17 epitope E2 trunk2 | artificial aa | EVVSSIDIGPPETISAQMELTVTVTSVKFTEELKNHSS QEFQEFKQTFTEQMNIVYSGIPEYVGVNITKLRLGSV VVEHDVLLRTKYTPEYKTVLDNATEVVKEKITKVTT QQIMINDICSDMMCFNTTGTQVQNITVTQYDPEEDC RKMAKEYGDYFVVEYRDQKPYCISPCEPGFSVSKNC NLGKCQMSLSGPQCLCVTTETHWYSGETCNQGTQK SL |
| 533. | MUC17 epitope E2 trunk3 | artificial aa | ISAQMELTVTVTSVKFTEELKNHSSQEFQEFKQTFTE QMNIVYSGIPEYVGVNITKLRLGSVVVEHDVLLRTK YTPEYKTVLDNATEVVKEKITKVTTQQIMINDICSD MMCFNTTGTQVQNITVTQYDPEEDCRKMAKEYGD YFVVEYRDQKPYCISPCEPGFSVSKNCNLGKCQMSL SGPQCLCVTTETHWYSGETCNQGTQKSL |
| 534. | MUC17 epitope E2 trunk4 | artificial aa | DMMCFNTTGTQVQNITVTQYDPEEDCRKMAKEYG DYFVVEYRDQKPYCISPCEPGFSVSKNCNLGKCQMS LSGPQCLCVTTETHWYSGETCNQGTQKSL |
| 535. | MUC17 epitope E2 trunk5 | artificial aa | SPCEPGFSVSKNCNLGKCQMSLSGPQCLCVTTETHW YSGETCNQGTQKSL |

SEQUENCE LISTING (605 sequences)

SEQ ID NO: 1 - protein, 5 aa, Artificial Sequence
  Synthetic Polypeptide
  MISC_FEATURE: G4S linker
GGGGS

SEQ ID NO: 2 - protein, 10 aa, Artificial Sequence
  Synthetic Polypeptide
  MISC_FEATURE: (G4S)2 linker
GGGGSGGGGS

SEQ ID NO: 3 - protein, 15 aa, Artificial Sequence
  Synthetic Polypeptide
  MISC_FEATURE: (G4S)3 linker
GGGGSGGGGSGGGGS

SEQ ID NO: 4 - protein, 20 aa, Artificial Sequence
  Synthetic Polypeptide
  MISC_FEATURE: (G4S)4 linker
GGGGSGGGGSGGGGSGGGGS

SEQ ID NO: 5 - protein, 25 aa, Artificial Sequence
  Synthetic Polypeptide
  MISC_FEATURE: (G4S)5 linker
GGGGSGGGGSGGGGSGGGGSGGGGS

SEQ ID NO: 6 - protein, 30 aa, Artificial Sequence
  Synthetic Polypeptide
  MISC_FEATURE: (G4S)6 linker
GGGGSGGGGSGGGGSGGGGSGGGGSGGGGS

SEQ ID NO: 7 - protein, 35 aa, Artificial Sequence
  Synthetic Polypeptide
  MISC_FEATURE: (G4S)7 linker
GGGGSGGGGSGGGGSGGGGSGGGGSGGGGSGGGGS

SEQ ID NO: 8 - protein, 40 aa, Artificial Sequence
  Synthetic Polypeptide
  MISC_FEATURE: (G4S)8 linker
GGGGSGGGGSGGGGSGGGGSGGGGSGGGGSGGGGSGGGGS

SEQ ID NO: 9 - protein, 6 aa, Artificial Sequence
  Synthetic Polypeptide
  MISC_FEATURE: Peptide linker
PGGGGS

SEQ ID NO: 10 - protein, 6 aa, Artificial Sequence
  Synthetic Polypeptide
  MISC_FEATURE: Peptide linker
PGGDGS

SEQ ID NO: 11 - protein, 6 aa, Artificial Sequence
  Synthetic Polypeptide
  MISC_FEATURE: Peptide linker
SGGGGS

SEQ ID NO: 12 - protein, 4 aa, Artificial Sequence
  Synthetic Polypeptide
  MISC_FEATURE: Peptide linker
GGGG

SEQ ID NO: 13 - protein, 109 aa, Artificial Sequence
  Synthetic Polypeptide
  MISC_FEATURE: CD3? binder VL
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 14 - protein, 125 aa, Artificial Sequence
  Synthetic Polypeptide
  MISC_FEATURE: CD3? binder VH
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSS

SEQ ID NO: 15 - protein, 249 aa, Artificial Sequence
  Synthetic Polypeptide
  MISC_FEATURE: CD3? binder scFv
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 16 - protein, 6 aa, Artificial Sequence
  Synthetic Polypeptide
  MISC_FEATURE: hexa-histidine tag
HHHHHH

SEQ ID NO: 17 - protein, 227 aa, Artificial Sequence
  Synthetic Polypeptide
  MISC_FEATURE: Fc monomer-1 +c/-g
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 225 aa, Artificial Sequence
  Synthetic Polypeptide
  MISC_FEATURE: Fc monomer-2 +c/-g/delGK
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 19 - protein, 227 aa, Artificial Sequence
  Synthetic Polypeptide
  MISC_FEATURE: Fc monomer-3 -c/+g
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 225 aa, Artificial Sequence
  Synthetic Polypeptide
  MISC_FEATURE: Fc monomer-4 -c/+g/delGK
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 21 - protein, 227 aa, Artificial Sequence
  Synthetic Polypeptide
  MISC_FEATURE: Fc monomer-5 -c/-g
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 225 aa, Artificial Sequence
  Synthetic Polypeptide
  MISC_FEATURE: Fc monomer-6 -c/-g/delGK
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 23 - protein, 227 aa, Artificial Sequence
  Synthetic Polypeptide
  MISC_FEATURE: Fc monomer-7 +c/+g
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 225 aa, Artificial Sequence
  Synthetic Polypeptide
  MISC_FEATURE: Fc monomer-8 +c/+g/delGK
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 25 - protein, 484 aa, Artificial Sequence
  Synthetic Polypeptide
  MISC_FEATURE: scFc-1
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 480 aa, Artificial Sequence
  Synthetic Polypeptide
  MISC_FEATURE: scFc-2
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 27 - protein, 484 aa, Artificial Sequence
  Synthetic Polypeptide
  MISC_FEATURE: scFc-3
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 480 aa, Artificial Sequence
  Synthetic Polypeptide
  MISC_FEATURE: scFc-4
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 29 - protein, 484 aa, Artificial Sequence
  Synthetic Polypeptide
  MISC_FEATURE: scFc-5
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 480 aa, Artificial Sequence
  Synthetic Polypeptide
  MISC_FEATURE: scFc-6
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 31 - protein, 484 aa, Artificial Sequence
  Synthetic Polypeptide
  MISC_FEATURE: scFc-7
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 480 aa, Artificial Sequence
  Synthetic Polypeptide
  MISC_FEATURE: scFc-8
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 33 - protein, 5 aa, Artificial Sequence
  Synthetic Polypeptide
  MISC_FEATURE: MU 92-G6 CC x I2C0-scFc VH CDR1
SYGMH

SEQ ID NO: 34 - protein, 17 aa, Artificial Sequence
  Synthetic Polypeptide
  MISC_FEATURE: MU 92-G6 CC x I2C0-scFc VH CDR2
VISFEGSNKYYASSVKG

SEQ ID NO: 35 - protein, 9 aa, Artificial Sequence
  Synthetic Polypeptide
  MISC_FEATURE: MU 92-G6 CC x I2C0-scFc VH CDR3
GAYTYGFDY

SEQ ID NO: 36 - protein, 11 aa, Artificial Sequence
  Synthetic Polypeptide
  MISC_FEATURE: MU 92-G6 CC x I2C0-scFc VL CDR1
RASQSVNRYLA

SEQ ID NO: 37 - protein, 7 aa, Artificial Sequence
  Synthetic Polypeptide
  MISC_FEATURE: MU 92-G6 CC x I2C0-scFc VL CDR2
GASNRAT

SEQ ID NO: 38 - protein, 9 aa, Artificial Sequence
  Synthetic Polypeptide
  MISC_FEATURE: MU 92-G6 CC x I2C0-scFc VL CDR3
HHYGSSIFA

SEQ ID NO: 39 - protein, 118 aa, Artificial Sequence
  Synthetic Polypeptide
  MISC_FEATURE: MU 92-G6 CC x I2C0-scFc VH
QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSS

SEQ ID NO: 40 - protein, 107 aa, Artificial Sequence
  Synthetic Polypeptide
  MISC_FEATURE: MU 92-G6 CC x I2C0-scFc VL
EIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 41 - protein, 240 aa, Artificial Sequence
  Synthetic Polypeptide
  MISC_FEATURE: MU 92-G6 CC x I2C0-scFc scFv
QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 42 - protein, 495 aa, Artificial Sequence
  Synthetic Polypeptide
  MISC_FEATURE: MU 92-G6 CC x I2C0-scFc Bispecific molecule
QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 43 - protein, 983 aa, Artificial Sequence
  Synthetic Polypeptide
  MISC_FEATURE: MU 92-G6 CC x I2C0-scFc Bispecific HLE molecule
QVQLVESGGGVVQPGRSLRLSCAASGFTFSSYGMHWVRQAPGKCLEWVAVISFEGSNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 5 aa, Artificial Sequence
  Synthetic Polypeptide
  MISC_FEATURE: MU 92-C12 CC x I2C0-scFc VH CDR1
SFGMH

SEQ ID NO: 45 - protein, 17 aa, Artificial Sequence
  Synthetic Polypeptide
  MISC_FEATURE: MU 92-C12 CC x I2C0-scFc VH CDR2
VIWFSGSNKYYAEAVKG

SEQ ID NO: 46 - protein, 9 aa, Artificial Sequence
  Synthetic Polypeptide
  MISC_FEATURE: MU 92-C12 CC x I2C0-scFc VH CDR3
GGYTYGFDY

SEQ ID NO: 47 - protein, 11 aa, Artificial Sequence
  Synthetic Polypeptide
  MISC_FEATURE: MU 92-C12 CC x I2C0-scFc VL CDR1
RANQAINRYLA

SEQ ID NO: 48 - protein, 7 aa, Artificial Sequence
  Synthetic Polypeptide
  MISC_FEATURE: MU 92-C12 CC x I2C0-scFc VL CDR2
GASSRAT

SEQ ID NO: 49 - protein, 9 aa, Artificial Sequence
  Synthetic Polypeptide
  MISC_FEATURE: MU 92-C12 CC x I2C0-scFc VL CDR3
HHYGSSIFT

SEQ ID NO: 50 - protein, 118 aa, Artificial Sequence
  Synthetic Polypeptide
  MISC_FEATURE: MU 92-C12 CC x I2C0-scFc VH
QVQLVESGGGVVQPGRSLRLSCAASGFTFSSFGMHWVRQAPGKCLEWVAVIWFSGSNKYYAEAVKGRFTISRDNSKNTLYLQMNNLRAEDTAVYYCARGGYTYGFDYWGQGTLVTVSS

SEQ ID NO: 51 - protein, 107 aa, Artificial Sequence
  Synthetic Polypeptide
  MISC_FEATURE: MU 92-C12 CC x I2C0-scFc VL
EIVLTQSPATLSLSPGERATLSCRANQAINRYLAWYQQKPGQAPRLLIYGASSRATGIPDRFSGSGSGTDFTLTISRLEPEDFAVYYCHHYGSSIFTFGCGTKVEIK

SEQ ID NO: 52 - protein, 240 aa, Artificial Sequence
  Synthetic Polypeptide
  MISC_FEATURE: MU 92-C12 CC x I2C0-scFc scFv
QVQLVESGGGVVQPGRSLRLSCAASGFTFSSFGMHWVRQAPGKCLEWVAVIWFSGSNKYYAEAVKGRFTISRDNSKNTLYLQMNNLRAEDTAVYYCARGGYTYGFDYWGQGTLVTVSSGGGGSGGGGSGGGGSEIVLTQSPATLSLSPGERATLSCRANQAINRYLAWYQQKPGQAPRLLIYGASSRATGIPDRFSGSGSGTDFTLTISRLEPEDFAVYYCHHYGSSIFTFGCGTKVEIK

SEQ ID NO: 53 - protein, 495 aa, Artificial Sequence
  Synthetic Polypeptide
  MISC_FEATURE: MU 92-C12 CC x I2C0-scFc Bispecific molecule
QVQLVESGGGVVQPGRSLRLSCAASGFTFSSFGMHWVRQAPGKCLEWVAVIWFSGSNKYYAEAVKGRFTISRDNSKNTLYLQMNNLRAEDTAVYYCARGGYTYGFDYWGQGTLVTVSSGGGGSGGGGSGGGGSEIVLTQSPATLSLSPGERATLSCRANQAINRYLAWYQQKPGQAPRLLIYGASSRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 54 - protein, 983 aa, Artificial Sequence
  Synthetic Polypeptide
  MISC_FEATURE: MU 92-C12 CC x I2C0-scFc Bispecific HLE molecule
QVQLVESGGGVVQPGRSLRLSCAASGFTFSSFGMHWVRQAPGKCLEWVAVIWFSGSNKYYAEAVKGRFTISRDNSKNTLYLQMNNLRAEDTAVYYCARGGYTYGFDYWGQGTLVTVSSGGGGSGGGGSGGGGSEIVLTQSPATLSLSPGERATLSCRANQAINRYLAWYQQKPGQAPRLLIYGASSRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 5 aa, Artificial Sequence
  Synthetic Polypeptide
  MISC_FEATURE: MU 32-G6 CC x I2C0-scFc VH CDR1
NHAMH

SEQ ID NO: 56 - protein, 17 aa, Artificial Sequence
  Synthetic Polypeptide
  MISC_FEATURE: MU 32-G6 CC x I2C0-scFc VH CDR2
GIWSEGSNKYYAESVKG

SEQ ID NO: 57 - protein, 12 aa, Artificial Sequence
  Synthetic Polypeptide
  MISC_FEATURE: MU 32-G6 CC x I2C0-scFc VH CDR3
ATYTTGWSYFDY

SEQ ID NO: 58 - protein, 11 aa, Artificial Sequence
  Synthetic Polypeptide
  MISC_FEATURE: MU 32-G6 CC x I2C0-scFc VL CDR1
SGDKLGDKYAS

SEQ ID NO: 59 - protein, 7 aa, Artificial Sequence
  Synthetic Polypeptide
  MISC_FEATURE: MU 32-G6 CC x I2C0-scFc VL CDR2
QDRKRPS

SEQ ID NO: 60 - protein, 9 aa, Artificial Sequence
  Synthetic Polypeptide
  MISC_FEATURE: MU 32-G6 CC x I2C0-scFc VL CDR3
QAYDASTWV

SEQ ID NO: 61 - protein, 121 aa, Artificial Sequence
  Synthetic Polypeptide
  MISC_FEATURE: MU 32-G6 CC x I2C0-scFc VH
QVQLVESGGGVVQPGRSLRLSCAASGFTFSNHAMHWVRQAPGKCLEWVAGIWSEGSNKYYAESVKGRFTISRDNSKNTLYLQMNSLRAEDTAVYYCARATYTTGWSYFDYWGQGTLVTVSS

SEQ ID NO: 62 - protein, 106 aa, Artificial Sequence
  Synthetic Polypeptide
  MISC_FEATURE: MU 32-G6 CC x I2C0-scFc VL
SYELTQPPSVSVSPGQTASITCSGDKLGDKYASWYQQKSGQSPVLVIYQDRKRPSGIPERFSGSNSGNTATLTISGTQAMDEADYYCQAYDASTWVFGCGTQLTVL

SEQ ID NO: 63 - protein, 242 aa, Artificial Sequence
  Synthetic Polypeptide
  MISC_FEATURE: MU 32-G6 CC x I2C0-scFc scFv
QVQLVESGGGVVQPGRSLRLSCAASGFTFSNHAMHWVRQAPGKCLEWVAGIWSEGSNKYYAESVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDRKRPSGIPERFSGSNSGNTATLTISGTQAMDEADYYCQAYDASTWVFGCGTQLTVL

SEQ ID NO: 64 - protein, 497 aa, Artificial Sequence
  Synthetic Polypeptide
  MISC_FEATURE: MU 32-G6 CC x I2C0-scFc Bispecific molecule
QVQLVESGGGVVQPGRSLRLSCAASGFTFSNHAMHWVRQAPGKCLEWVAGIWSEGSNKYYAESVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDRKRPSGIPERFSGSNSGNTATLTISGTQAMDEADYYCQAYDASTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 65 - protein, 985 aa, Artificial Sequence
  Synthetic Polypeptide
  MISC_FEATURE: MU 32-G6 CC x I2C0-scFc Bispecific HLE molecule
QVQLVESGGGVVQPGRSLRLSCAASGFTFSNHAMHWVRQAPGKCLEWVAGIWSEGSNKYYAESVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDRKRPSGIPERFSGSNSGNTATLTISGTQAMDEADYYCQAYDASTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 5 aa, Artificial Sequence
  Synthetic Polypeptide
  MISC_FEATURE: MU 9-C2 CC x I2C0-scFc VH CDR1
NFGMH

SEQ ID NO: 67 - protein, 17 aa, Artificial Sequence
  Synthetic Polypeptide
  MISC_FEATURE: MU 9-C2 CC x I2C0-scFc VH CDR2
VIWFDASKTYYASSVKG

SEQ ID NO: 68 - protein, 12 aa, Artificial Sequence
  Synthetic Polypeptide
  MISC_FEATURE: MU 9-C2 CC x I2C0-scFc VH CDR3
ATYSTGWSYFDY

SEQ ID NO: 69 - protein, 11 aa, Artificial Sequence
  Synthetic Polypeptide
  MISC_FEATURE: MU 9-C2 CC x I2C0-scFc VL CDR1
SGDKLGDKYTS

SEQ ID NO: 70 - protein, 7 aa, Artificial Sequence
  Synthetic Polypeptide
  MISC_FEATURE: MU 9-C2 CC x I2C0-scFc VL CDR2
HDAKRPS

SEQ ID NO: 71 - protein, 10 aa, Artificial Sequence
  Synthetic Polypeptide
  MISC_FEATURE: MU 9-C2 CC x I2C0-scFc VL CDR3
QAWDASTAWV

SEQ ID NO: 72 - protein, 121 aa, Artificial Sequence
  Synthetic Polypeptide
  MISC_FEATURE: MU 9-C2 CC x I2C0-scFc VH
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSS

SEQ ID NO: 73 - protein, 107 aa, Artificial Sequence
  Synthetic Polypeptide
  MISC_FEATURE: MU 9-C2 CC x I2C0-scFc VL
SYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVL

SEQ ID NO: 74 - protein, 243 aa, Artificial Sequence
  Synthetic Polypeptide
  MISC_FEATURE: MU 9-C2 CC x I2C0-scFc scFv
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVL

SEQ ID NO: 75 - protein, 498 aa, Artificial Sequence
  Synthetic Polypeptide
  MISC_FEATURE: MU 9-C2 CC x I2C0-scFc Bispecific molecule
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 76 - protein, 986 aa, Artificial Sequence
  Synthetic Polypeptide
  MISC_FEATURE: MU 9-C2 CC x I2C0-scFc Bispecific HLE molecule
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 5 aa, Artificial Sequence
  Synthetic Polypeptide
  MISC_FEATURE: MU 8-H9 CC x I2C0-scFc VH CDR1
GYYWS

SEQ ID NO: 78 - protein, 16 aa, Artificial Sequence
  Synthetic Polypeptide
  MISC_FEATURE: MU 8-H9 CC x I2C0-scFc VH CDR2
DIEHSGSTKYNPSLKS

SEQ ID NO: 79 - protein, 12 aa, Artificial Sequence
  Synthetic Polypeptide
  MISC_FEATURE: MU 8-H9 CC x I2C0-scFc VH CDR3
KKYSTVWSYFDY

SEQ ID NO: 80 - protein, 11 aa, Artificial Sequence
  Synthetic Polypeptide
  MISC_FEATURE: MU 8-H9 CC x I2C0-scFc VL CDR1
SGDKLGDKYAS

SEQ ID NO: 81 - protein, 7 aa, Artificial Sequence
  Synthetic Polypeptide
  MISC_FEATURE: MU 8-H9 CC x I2C0-scFc VL CDR2
HDNKRPS

SEQ ID NO: 82 - protein, 9 aa, Artificial Sequence
  Synthetic Polypeptide
  MISC_FEATURE: MU 8-H9 CC x I2C0-scFc VL CDR3
QAYGSSSAV

SEQ ID NO: 83 - protein, 120 aa, Artificial Sequence
  Synthetic Polypeptide
  MISC_FEATURE: MU 8-H9 CC x I2C0-scFc VH
QVQLQQWGAGLLKPSETLSLTCAVYGGSFSGYYWSWIRQPPGKCLEWIGDIEHSGSTKYNPSLKSRVTISLDTSKNQFSLKLNSVTAADTAVYFCARKKYSTVWSYFDYWGQGTLVTVSS

SEQ ID NO: 84 - protein, 106 aa, Artificial Sequence
  Synthetic Polypeptide
  MISC_FEATURE: MU 8-H9 CC x I2C0-scFc VL
SYELTQSPSASVSPGQTASITCSGDKLGDKYASWYQQKPGQSPVLVIYHDNKRPSGIPERFSGSNSGNTATLTISGTQAMDEADYYCQAYGSSSAVFGCGTKLTVL

SEQ ID NO: 85 - protein, 241 aa, Artificial Sequence
  Synthetic Polypeptide
  MISC_FEATURE: MU 8-H9 CC x I2C0-scFc scFv
QVQLQQWGAGLLKPSETLSLTCAVYGGSFSGYYWSWIRQPPGKCLEWIGDIEHSGSTKYNPSLKSRVTISLDTSKNQFSLKLNSVTAADTAVYFCARKKYSTVWSYFDYWGQGTLVTVSSGGGGSGGGGSGGGGSSYELTQSPSASVSPGQTASITCSGDKLGDKYASWYQQKPGQSPVLVIYHDNKRPSGIPERFSGSNSGNTATLTISGTQAMDEADYYCQAYGSSSAVFGCGTKLTVL

SEQ ID NO: 86 - protein, 496 aa, Artificial Sequence
  Synthetic Polypeptide
  MISC_FEATURE: MU 8-H9 CC x I2C0-scFc Bispecific molecule
QVQLQQWGAGLLKPSETLSLTCAVYGGSFSGYYWSWIRQPPGKCLEWIGDIEHSGSTKYNPSLKSRVTISLDTSKNQFSLKLNSVTAADTAVYFCARKKYSTVWSYFDYWGQGTLVTVSSGGGGSGGGGSGGGGSSYELTQSPSASVSPGQTASITCSGDKLGDKYASWYQQKPGQSPVLVIYHDNKRPSGIPERFSGSNSGNTATLTISGTQAMDEADYYCQAYGSSSAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 87 - protein, 984 aa, Artificial Sequence
  Synthetic Polypeptide
  MISC_FEATURE: MU 8-H9 CC x I2C0-scFc Bispecific HLE molecule
QVQLQQWGAGLLKPSETLSLTCAVYGGSFSGYYWSWIRQPPGKCLEWIGDIEHSGSTKYNPSLKSRVTISLDTSKNQFSLKLNSVTAADTAVYFCARKKYSTVWSYFDYWGQGTLVTVSSGGGGSGGGGSGGGGSSYELTQSPSASVSPGQTASITCSGDKLGDKYASWYQQKPGQSPVLVIYHDNKRPSGIPERFSGSNSGNTATLTISGTQAMDEADYYCQAYGSSSAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 5 aa, Artificial Sequence
  Synthetic Polypeptide
  MISC_FEATURE: MU 8-H8 CC x I2C0-scFc VH CDR1
GYYWS

SEQ ID NO: 89 - protein, 16 aa, Artificial Sequence
  Synthetic Polypeptide
  MISC_FEATURE: MU 8-H8 CC x I2C0-scFc VH CDR2
DIDASGSTKYNPSLKS

SEQ ID NO: 90 - protein, 12 aa, Artificial Sequence
  Synthetic Polypeptide
  MISC_FEATURE: MU 8-H8 CC x I2C0-scFc VH CDR3
KKYSTVWSYFDY

SEQ ID NO: 91 - protein, 11 aa, Artificial Sequence
  Synthetic Polypeptide
  MISC_FEATURE: MU 8-H8 CC x I2C0-scFc VL CDR1
SGDKLGDKYAS

SEQ ID NO: 92 - protein, 7 aa, Artificial Sequence
  Synthetic Polypeptide
  MISC_FEATURE: MU 8-H8 CC x I2C0-scFc VL CDR2
QDRKRPS

SEQ ID NO: 93 - protein, 9 aa, Artificial Sequence
  Synthetic Polypeptide
  MISC_FEATURE: MU 8-H8 CC x I2C0-scFc VL CDR3
QAWGSSTAV

SEQ ID NO: 94 - protein, 120 aa, Artificial Sequence
  Synthetic Polypeptide
  MISC_FEATURE: MU 8-H8 CC x I2C0-scFc VH
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSS

SEQ ID NO: 95 - protein, 106 aa, Artificial Sequence
  Synthetic Polypeptide
  MISC_FEATURE: MU 8-H8 CC x I2C0-scFc VL
SYELTQPPSVSVPPGQTASITCSGDKLGDKYASWYQQKPGQSPVLIIYQDRKRPSGVPERFSGSNSGNTATLTISGTQAMDEADYYCQAWGSSTAVFGCGTKLTVL

SEQ ID NO: 96 - protein, 241 aa, Artificial Sequence
  Synthetic Polypeptide
  MISC_FEATURE: MU 8-H8 CC x I2C0-scFc scFv
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSTAVFGCGTKLTVL

SEQ ID NO: 97 - protein, 496 aa, Artificial Sequence
  Synthetic Polypeptide
  MISC_FEATURE: MU 8-H8 CC x I2C0-scFc Bispecific molecule
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 98 - protein, 984 aa, Artificial Sequence
  Synthetic Polypeptide
  MISC_FEATURE: MU 8-H8 CC x I2C0-scFc Bispecific HLE molecule
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 5 aa, Artificial Sequence
  Synthetic Polypeptide
  MISC_FEATURE: MU 8-H5 CC x I2C0-scFc VH CDR1
SFGMH

SEQ ID NO: 100 - protein, 17 aa, Artificial Sequence
  Synthetic Polypeptide
  MISC_FEATURE: MU 8-H5 CC x I2C0-scFc VH CDR2
VIWFDASNKYYAESVKG

SEQ ID NO: 101 - protein, 9 aa, Artificial Sequence
  Synthetic Polypeptide
  MISC_FEATURE: MU 8-H5 CC x I2C0-scFc VH CDR3
GGYTYGFDY

SEQ ID NO: 102 - protein, 11 aa, Artificial Sequence
  Synthetic Polypeptide
  MISC_FEATURE: MU 8-H5 CC x I2C0-scFc VL CDR1
RASQAVNRYLA

SEQ ID NO: 103 - protein, 7 aa, Artificial Sequence
  Synthetic Polypeptide
  MISC_FEATURE: MU 8-H5 CC x I2C0-scFc VL CDR2
GASSRAT

SEQ ID NO: 104 - protein, 9 aa, Artificial Sequence
  Synthetic Polypeptide
  MISC_FEATURE: MU 8-H5 CC x I2C0-scFc VL CDR3
QQYGSSIFT

SEQ ID NO: 105 - protein, 118 aa, Artificial Sequence
  Synthetic Polypeptide
  MISC_FEATURE: MU 8-H5 CC x I2C0-scFc VH
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSS

SEQ ID NO: 106 - protein, 107 aa, Artificial Sequence
  Synthetic Polypeptide
  MISC_FEATURE: MU 8-H5 CC x I2C0-scFc VL
EIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIK

SEQ ID NO: 107 - protein, 240 aa, Artificial Sequence
  Synthetic Polypeptide
  MISC_FEATURE: MU 8-H5 CC x I2C0-scFc scFv
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIK

SEQ ID NO: 108 - protein, 495 aa, Artificial Sequence
  Synthetic Polypeptide
  MISC_FEATURE: MU 8-H5 CC x I2C0-scFc Bispecific molecule
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 109 - protein, 983 aa, Artificial Sequence
  Synthetic Polypeptide
  MISC_FEATURE: MU 8-H5 CC x I2C0-scFc Bispecific HLE molecule
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSLSPGERATLSCRASQAVNRYLAWYQQKPGQAPRLLIYGASSRATGIPDRFSGSGSGTDFTLTISRLEPEDFAVYYCQQYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 5 aa, Artificial Sequence
  Synthetic Polypeptide
  MISC_FEATURE: MU 8-F11 CC x I2C0-scFc VH CDR1
SHYWS

SEQ ID NO: 111 - protein, 16 aa, Artificial Sequence
  Synthetic Polypeptide
  MISC_FEATURE: MU 8-F11 CC x I2C0-scFc VH CDR2
RIDVSGSANYNPALKS

SEQ ID NO: 112 - protein, 12 aa, Artificial Sequence
  Synthetic Polypeptide
  MISC_FEATURE: MU 8-F11 CC x I2C0-scFc VH CDR3
APYSSGWGYFDY

SEQ ID NO: 113 - protein, 11 aa, Artificial Sequence
  Synthetic Polypeptide
  MISC_FEATURE: MU 8-F11 CC x I2C0-scFc VL CDR1
SGDKLGDKYAS

SEQ ID NO: 114 - protein, 7 aa, Artificial Sequence
  Synthetic Polypeptide
  MISC_FEATURE: MU 8-F11 CC x I2C0-scFc VL CDR2
HDNKRPS

SEQ ID NO: 115 - protein, 9 aa, Artificial Sequence
  Synthetic Polypeptide
  MISC_FEATURE: MU 8-F11 CC x I2C0-scFc VL CDR3
QAWDITTAV

SEQ ID NO: 116 - protein, 120 aa, Artificial Sequence
  Synthetic Polypeptide
  MISC_FEATURE: MU 8-F11 CC x I2C0-scFc VH
QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSS

SEQ ID NO: 117 - protein, 106 aa, Artificial Sequence
  Synthetic Polypeptide
  MISC_FEATURE: MU 8-F11 CC x I2C0-scFc VL
SYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVL

SEQ ID NO: 118 - protein, 241 aa, Artificial Sequence
  Synthetic Polypeptide
  MISC_FEATURE: MU 8-F11 CC x I2C0-scFc scFv
QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSSGGGGSGGGGSGGGGSSYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVL

SEQ ID NO: 119 - protein, 496 aa, Artificial Sequence
  Synthetic Polypeptide
  MISC_FEATURE: MU 8-F11 CC x I2C0-scFc Bispecific molecule
QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSSGGGGSGGGGSGGGGSSYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 120 - protein, 984 aa, Artificial Sequence
  Synthetic Polypeptide
  MISC_FEATURE: MU 8-F11 CC x I2C0-scFc Bispecific HLE molecule
QVQLQESGPGLVKPSETLSLTCTVSGGSISSHYWSWIRQSAGKCLEWIGRIDVSGSANYNPALKSRATMSADTSKNQFSLRLSSVTAADTAVYYCARAPYSSGWGYFDYWGQGTLVTVSSGGGGSGGGGSGGGGSSYELTQPPSVSVSPGQTASITCSGDKLGDKYASWYQQQPGQSPVLVIYHDNKRPSGIPERFSGSNSGNTATLTISGTQAMDEADYFCQAWDITTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 5 aa, Artificial Sequence
  Synthetic Polypeptide
  MISC_FEATURE: MU 8-F9 CC x I2C0-scFc VH CDR1
GYYWS

SEQ ID NO: 122 - protein, 16 aa, Artificial Sequence
  Synthetic Polypeptide
  MISC_FEATURE: MU 8-F9 CC x I2C0-scFc VH CDR2
DIDASGSTKYNPSLKS

SEQ ID NO: 123 - protein, 12 aa, Artificial Sequence
  Synthetic Polypeptide
  MISC_FEATURE: MU 8-F9 CC x I2C0-scFc VH CDR3
KKYSTVWSYFDY

SEQ ID NO: 124 - protein, 11 aa, Artificial Sequence
  Synthetic Polypeptide
  MISC_FEATURE: MU 8-F9 CC x I2C0-scFc VL CDR1
SGDKLGDKYAS

SEQ ID NO: 125 - protein, 7 aa, Artificial Sequence
  Synthetic Polypeptide
  MISC_FEATURE: MU 8-F9 CC x I2C0-scFc VL CDR2
QDRKRPS

SEQ ID NO: 126 - protein, 9 aa, Artificial Sequence
  Synthetic Polypeptide
  MISC_FEATURE: MU 8-F9 CC x I2C0-scFc VL CDR3
QAWGSSAAV

SEQ ID NO: 127 - protein, 120 aa, Artificial Sequence; identical to SEQ ID NO: 94
  Synthetic Polypeptide
  MISC_FEATURE: MU 8-F9 CC x I2C0-scFc VH

SEQ ID NO: 128 - protein, 106 aa, Artificial Sequence
  Synthetic Polypeptide
  MISC_FEATURE: MU 8-F9 CC x I2C0-scFc VL
SYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVL

SEQ ID NO: 129 - protein, 241 aa, Artificial Sequence
  Synthetic Polypeptide
  MISC_FEATURE: MU 8-F9 CC x I2C0-scFc scFv
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVL

SEQ ID NO: 130 - protein, 496 aa, Artificial Sequence
  Synthetic Polypeptide
  MISC_FEATURE: MU 8-F9 CC x I2C0-scFc Bispecific molecule
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 131 - protein, 984 aa, Artificial Sequence
  Synthetic Polypeptide
  MISC_FEATURE: MU 8-F9 CC x I2C0-scFc Bispecific HLE molecule
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGDKYASWYQQKPGQSPVLVIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 5 aa, Artificial Sequence
  Synthetic Polypeptide
  MISC_FEATURE: MU 8-E3 CC X I2C0-scFc VH CDR1
NHGMH

SEQ ID NO: 133 - protein, 17 aa, Artificial Sequence
  Synthetic Polypeptide
  MISC_FEATURE: MU 8-E3 CC X I2C0-scFc VH CDR2
GIWSDASNKYYADAVKG

SEQ ID NO: 134 - protein, 12 aa, Artificial Sequence
  Synthetic Polypeptide
  MISC_FEATURE: MU 8-E3 CC X I2C0-scFc VH CDR3
ATYTTGWSYFDY

SEQ ID NO: 135 - protein, 11 aa, Artificial Sequence
  Synthetic Polypeptide
  MISC_FEATURE: MU 8-E3 CC X I2C0-scFc VL CDR1
SGDKLGDKYAS

SEQ ID NO: 136 - protein, 7 aa, Artificial Sequence
  Synthetic Polypeptide
  MISC_FEATURE: MU 8-E3 CC X I2C0-scFc VL CDR2
QDNKRPS

SEQ ID NO: 137 - protein, 9 aa, Artificial Sequence
  Synthetic Polypeptide
  MISC_FEATURE: MU 8-E3 CC X I2C0-scFc VL CDR3
QAYDASTWV

SEQ ID NO: 138 - protein, 121 aa, Artificial Sequence
  Synthetic Polypeptide
  MISC_FEATURE: MU 8-E3 CC X I2C0-scFc VH
QVQLVESGGGVVQPGRSLRLACAASGFTFSNHGMHWVRQAPGKCLEWVAGIWSDASNKYYADAVKGRFTISRDNSKNTLYLQMNSLRAEDTAVYYCARATYTTGWSYFDYWGQGTLVTVSS

SEQ ID NO: 139 - protein, 106 aa, Artificial Sequence
  Synthetic Polypeptide
  MISC_FEATURE: MU 8-E3 CC X I2C0-scFc VL
SYELTQPASVSVSPGQTASITCSGDKLGDKYASWYQQKSGQSPVLVIYQDNKRPSGIPERFSGSNSGNTATLTISGTQAMDEADYYCQAYDASTWVFGCGTQLTVL

SEQ ID NO: 140 - protein, 242 aa, Artificial Sequence
  Synthetic Polypeptide
  MISC_FEATURE: MU 8-E3 CC X I2C0-scFc scFv
QVQLVESGGGVVQPGRSLRLACAASGFTFSNHGMHWVRQAPGKCLEWVAGIWSDASNKYYADAVKGRFTISRDNSKNTLYLQMNSLRAEDTAVYYCARATYTTGWSYFDYWGQGTLVTVSSGGGGSGGGGSGGGGSSYELTQPASVSVSPGQTASITCSGDKLGDKYASWYQQKSGQSPVLVIYQDNKRPSGIPERFSGSNSGNTATLTISGTQAMDEADYYCQAYDASTWVFGCGTQLTVL

SEQ ID NO: 141 - protein, 497 aa, Artificial Sequence
  Synthetic Polypeptide
  MISC_FEATURE: MU 8-E3 CC X I2C0-scFc Bispecific molecule
QVQLVESGGGVVQPGRSLRLACAASGFTFSNHGMHWVRQAPGKCLEWVAGIWSDASNKYYADAVKGRFTISRDNSKNTLYLQMNSLRAEDTAVYYCARATYTTGWSYFDYWGQGTLVTVSSGGGGSGGGGSGGGGSSYELTQPASVSVSPGQTASITCSGDKLGDKYASWYQQKSGQSPVLVIYQDNKRPSGIPERFSGSNSGNTATLTISGTQAMDEADYYCQAYDASTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 142 - protein, 985 aa, Artificial Sequence
  Synthetic Polypeptide
  MISC_FEATURE: MU 8-E3 CC X I2C0-scFc Bispecific HLE molecule
QVQLVESGGGVVQPGRSLRLACAASGFTFSNHGMHWVRQAPGKCLEWVAGIWSDASNKYYADAVKGRFTISRDNSKNTLYLQMNSLRAEDTAVYYCARATYTTGWSYFDYWGQGTLVTVSSGGGGSGGGGSGGGGSSYELTQPASVSVSPGQTASITCSGDKLGDKYASWYQQKSGQSPVLVIYQDNKRPSGIPERFSGSNSGNTATLTISGTQAMDEADYYCQAYDASTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 143 - protein, 5 aa, Artificial Sequence
  Synthetic Polypeptide
  MISC_FEATURE: MU 8-D7 CC x I2C0-scFc VH CDR1
GYYWS

SEQ ID NO: 144 - protein, 16 aa, Artificial Sequence
  Synthetic Polypeptide
  MISC_FEATURE: MU 8-D7 CC x I2C0-scFc VH CDR2
DIDASGSTKYNPSLKS

SEQ ID NO: 145 - protein, 12 aa, Artificial Sequence
  Synthetic Polypeptide
  MISC_FEATURE: MU 8-D7 CC x I2C0-scFc VH CDR3
KKYSTVWSYFDY

SEQ ID NO: 146 - protein, 11 aa, Artificial Sequence
  Synthetic Polypeptide
  MISC_FEATURE: MU 8-D7 CC x I2C0-scFc VL CDR1
SGDKLGEKYAS

SEQ ID NO: 147 - protein, 7 aa, Artificial Sequence
  Synthetic Polypeptide
  MISC_FEATURE: MU 8-D7 CC x I2C0-scFc VL CDR2
QDRKRPS

SEQ ID NO: 148 - protein, 9 aa, Artificial Sequence
  Synthetic Polypeptide
  MISC_FEATURE: MU 8-D7 CC x I2C0-scFc VL CDR3
QAWGSSAAV

SEQ ID NO: 149 - protein, 120 aa, Artificial Sequence
  Synthetic Polypeptide
  MISC_FEATURE: MU 8-D7 CC x I2C0-scFc VH
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWRQGTLVTVSS

SEQ ID NO: 150 - protein, 106 aa, Artificial Sequence
  Synthetic Polypeptide
  MISC_FEATURE: MU 8-D7 CC x I2C0-scFc VL
SYELTQPSSVSVPPGQTASITCSGDKLGEKYASWYQQKPGQSPVLIIYQDRKRPSGVPERFSGSNSGNTATLTISGTQAMDEADYYCQAWGSSAAVFGCGTKLTVL

SEQ ID NO: 151 - protein, 242 aa, Artificial Sequence
  Synthetic Polypeptide
  MISC_FEATURE: MU 8-D7 CC x I2C0-scFc scFv
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWRQGTLVTVSSGGGGSGGGGSGGGGSSYELTQPSSVSVPPGQTASITCSGDKLGEKYASWYQQKPGQSPVLIIYQDRKRPSGVPERFSGSNSGNTATLTISGTQAMDEADYYCQAWGSSAAVFGCGTKLTVLS

SEQ ID NO: 152 - protein, 496 aa, Artificial Sequence
  Synthetic Polypeptide
  MISC_FEATURE: MU 8-D7 CC x I2C0-scFc Bispecific molecule
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWRQGTLVTVSSGGGGSGGGGSGGGGSSYELTQPSSVSVPPGQTASITCSGDKLGEKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 153 - protein, 984 aa, Artificial Sequence
  Synthetic Polypeptide
  MISC_FEATURE: MU 8-D7 CC x I2C0-scFc Bispecific HLE molecule
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDYWRQGTLVTVSSGGGGSGGGGSGGGGSSYELTQPSSVSVPPGQTASITCSGDKLGEKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 154 - protein, 5 aa, Artificial Sequence
  Synthetic Polypeptide
  MISC_FEATURE: MU 8-C7 CC x I2C0-scFc VH CDR1
GYYWS

SEQ ID NO: 155 - protein, 16 aa, Artificial Sequence
  Synthetic Polypeptide
  MISC_FEATURE: MU 8-C7 CC x I2C0-scFc VH CDR2
DIDQSGSTKYNPSLKS

SEQ ID NO: 156 - protein, 12 aa, Artificial Sequence
  Synthetic Polypeptide
  MISC_FEATURE: MU 8-C7 CC x I2C0-scFc VH CDR3
KKYSTVWSYFDY

SEQ ID NO: 157 - protein, 11 aa, Artificial Sequence
  Synthetic Polypeptide
  MISC_FEATURE: MU 8-C7 CC x I2C0-scFc VL CDR1
SGDKLGDKYAS

SEQ ID NO: 158 - protein, 7 aa, Artificial Sequence
  Synthetic Polypeptide
  MISC_FEATURE: MU 8-C7 CC x I2C0-scFc VL CDR2
QDRKRPS

SEQ ID NO: 159 - protein, 9 aa, Artificial Sequence
  Synthetic Polypeptide
  MISC_FEATURE: MU 8-C7 CC x I2C0-scFc VL CDR3
QAWGSSAAV

SEQ ID NO: 160 - protein, 120 aa, Artificial Sequence
  Synthetic Polypeptide
  MISC_FEATURE: MU 8-C7 CC x I2C0-scFc VH
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWRQGTLVTVSS

SEQ ID NO: 161 - protein, 106 aa, Artificial Sequence
  Synthetic Polypeptide
  MISC_FEATURE: MU 8-C7 CC x I2C0-scFc VL
SYELTQPSSVSVSPGQTASITCSGDKLGDKYASWYQQKPGQSPVLIIYQDRKRPSGVPERFSGSNSGNTATLTISGTQAMDEADYYCQAWGSSAAVFGCGTKLTVL

SEQ ID NO: 162 - protein, 241 aa, Artificial Sequence
  Synthetic Polypeptide
  MISC_FEATURE: MU 8-C7 CC x I2C0-scFc scFv
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWRQGTLVTVSSGGGGSGGGGSGGGGSSYELTQPSSVSVSPGQTASITCSGDKLGDKYASWYQQKPGQSPVLIIYQDRKRPSGVPERFSGSNSGNTATLTISGTQAMDEADYYCQAWGSSAAVFGCGTKLTVL

SEQ ID NO: 163 - protein, 496 aa, Artificial Sequence
  Synthetic Polypeptide
  MISC_FEATURE: MU 8-C7 CC x I2C0-scFc Bispecific molecule
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWRQGTLVTVSSGGGGSGGGGSGGGGSSYELTQPSSVSVSPGQTASITCSGDKLGDKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 164 - protein, 984 aa, Artificial Sequence
  Synthetic Polypeptide
  MISC_FEATURE: MU 8-C7 CC x I2C0-scFc Bispecific HLE molecule
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWRQGTLVTVSSGGGGSGGGGSGGGGSSYELTQPSSVSVSPGQTASITCSGDKLGDKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - protein, 5 aa, Artificial Sequence
  Synthetic Polypeptide
  MISC_FEATURE: MU 8-B8 CC x I2C0-scFc VH CDR1
GYYWS

SEQ ID NO: 166 - protein, 16 aa, Artificial Sequence
  Synthetic Polypeptide
  MISC_FEATURE: MU 8-B8 CC x I2C0-scFc VH CDR2
DIDQSGSTKYNPSLKS

SEQ ID NO: 167 - protein, 12 aa, Artificial Sequence
  Synthetic Polypeptide
  MISC_FEATURE: MU 8-B8 CC x I2C0-scFc VH CDR3
KKYSTVWSYFDY

SEQ ID NO: 168 - protein, 11 aa, Artificial Sequence
  Synthetic Polypeptide
  MISC_FEATURE: MU 8-B8 CC x I2C0-scFc VL CDR1
SGDKLGDKYAS

SEQ ID NO: 169 - protein, 7 aa, Artificial Sequence
  Synthetic Polypeptide
  MISC_FEATURE: MU 8-B8 CC x I2C0-scFc VL CDR2
QDRKRPS

SEQ ID NO: 170 - protein, 9 aa, Artificial Sequence
  Synthetic Polypeptide
  MISC_FEATURE: MU 8-B8 CC x I2C0-scFc VL CDR3
QAWGSSAAV

SEQ ID NO: 171 - protein, 120 aa, Artificial Sequence
  Synthetic Polypeptide
  MISC_FEATURE: MU 8-B8 CC x I2C0-scFc VH
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSS

SEQ ID NO: 172 - protein, 106 aa, Artificial Sequence
  Synthetic Polypeptide
  MISC_FEATURE: MU 8-B8 CC x I2C0-scFc VL
SYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVL

SEQ ID NO: 173 - protein, 241 aa, Artificial Sequence
  Synthetic Polypeptide
  MISC_FEATURE: MU 8-B8 CC x I2C0-scFc scFv
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVL

SEQ ID NO: 174 - protein, 496 aa, Artificial Sequence
  Synthetic Polypeptide
  MISC_FEATURE: MU 8-B8 CC x I2C0-scFc Bispecific molecule
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 175 - protein, 984 aa, Artificial Sequence
  Synthetic Polypeptide
  MISC_FEATURE: MU 8-B8 CC x I2C0-scFc Bispecific HLE molecule
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPPSVSVPPGQTASITCSGDKLGDKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 176 - protein, 5 aa, Artificial Sequence
  Synthetic Polypeptide
  MISC_FEATURE: MU 8-B7 CC x I2C0-scFc VH CDR1
GYYWS

SEQ ID NO: 177 - protein, 16 aa, Artificial Sequence
  Synthetic Polypeptide
  MISC_FEATURE: MU 8-B7 CC x I2C0-scFc VH CDR2
DIDASGSTKYNPSLKS

SEQ ID NO: 178 - protein, 12 aa, Artificial Sequence
  Synthetic Polypeptide
  MISC_FEATURE: MU 8-B7 CC x I2C0-scFc VH CDR3
KKYSTVWSYFDN

SEQ ID NO: 179 - protein, 11 aa, Artificial Sequence
  Synthetic Polypeptide
  MISC_FEATURE: MU 8-B7 CC x I2C0-scFc VL CDR1
SGDKLGDKYAS

SEQ ID NO: 180 - protein, 7 aa, Artificial Sequence
  Synthetic Polypeptide
  MISC_FEATURE: MU 8-B7 CC x I2C0-scFc VL CDR2
QDRKRPS

SEQ ID NO: 181 - protein, 9 aa, Artificial Sequence
  Synthetic Polypeptide
  MISC_FEATURE: MU 8-B7 CC x I2C0-scFc VL CDR3
QAWGSSTAV

SEQ ID NO: 182 - protein, 120 aa, Artificial Sequence
  Synthetic Polypeptide
  MISC_FEATURE: MU 8-B7 CC x I2C0-scFc VH
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSS

SEQ ID NO: 183 - protein, 106 aa, Artificial Sequence
  Synthetic Polypeptide
  MISC_FEATURE: MU 8-B7 CC x I2C0-scFc VL
SYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVL

SEQ ID NO: 184 - protein, 241 aa, Artificial Sequence
  Synthetic Polypeptide
  MISC_FEATURE: MU 8-B7 CC x I2C0-scFc scFv
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVL

SEQ ID NO: 185 - protein, 496 aa, Artificial Sequence
  Synthetic Polypeptide
  MISC_FEATURE: MU 8-B7 CC x I2C0-scFc Bispecific molecule
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 186 - protein, 984 aa, Artificial Sequence
  Synthetic Polypeptide
  MISC_FEATURE: MU 8-B7 CC x I2C0-scFc Bispecific HLE molecule
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 187 - protein, 5 aa, Artificial Sequence
  Synthetic Polypeptide
  MISC_FEATURE: MU 8-A7 CC x I2C0-scFc VH CDR1
GYYWS

SEQ ID NO: 188 - protein, 16 aa, Artificial Sequence
  Synthetic Polypeptide
  MISC_FEATURE: MU 8-A7 CC x I2C0-scFc VH CDR2
DIDQSGSTKYNPSLKS

SEQ ID NO: 189 - protein, 12 aa, Artificial Sequence
  Synthetic Polypeptide
  MISC_FEATURE: MU 8-A7 CC x I2C0-scFc VH CDR3
KKYSTVWSYFDY

SEQ ID NO: 190 - protein, 11 aa, Artificial Sequence
  Synthetic Polypeptide
  MISC_FEATURE: MU 8-A7 CC x I2C0-scFc VL CDR1
SGDKLGDKYAS

SEQ ID NO: 191 - protein, 7 aa, Artificial Sequence
  Synthetic Polypeptide
  MISC_FEATURE: MU 8-A7 CC x I2C0-scFc VL CDR2
QDRKRPS

SEQ ID NO: 192 - protein, 9 aa, Artificial Sequence
  Synthetic Polypeptide
  MISC_FEATURE: MU 8-A7 CC x I2C0-scFc VL CDR3
QAWGSSTAV

SEQ ID NO: 193 - protein, 120 aa, Artificial Sequence; identical to SEQ ID NO: 171
  Synthetic Polypeptide
  MISC_FEATURE: MU 8-A7 CC x I2C0-scFc VH

SEQ ID NO: 194 - protein, 106 aa, Artificial Sequence; identical to SEQ ID NO: 183
  Synthetic Polypeptide
  MISC_FEATURE: MU 8-A7 CC x I2C0-scFc VL

SEQ ID NO: 195 - protein, 241 aa, Artificial Sequence
  Synthetic Polypeptide
  MISC_FEATURE: MU 8-A7 CC x I2C0-scFc scFv
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVL

SEQ ID NO: 196 - protein, 496 aa, Artificial Sequence
  Synthetic Polypeptide
  MISC_FEATURE: MU 8-A7 CC x I2C0-scFc Bispecific molecule
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 197 - protein, 984 aa, Artificial Sequence
  Synthetic Polypeptide
  MISC_FEATURE: MU 8-A7 CC x I2C0-scFc Bispecific HLE molecule
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - protein, 5 aa, Artificial Sequence
  Synthetic Polypeptide
  MISC_FEATURE: MU 7-G6 CC x I2C0-scFc VH CDR1
SYGMH

SEQ ID NO: 199 - protein, 17 aa, Artificial Sequence
  Synthetic Polypeptide
  MISC_FEATURE: MU 7-G6 CC x I2C0-scFc VH CDR2
VIWYSGSNKYYATSVKG

SEQ ID NO: 200 - protein, 9 aa, Artificial Sequence
  Synthetic Polypeptide
  MISC_FEATURE: MU 7-G6 CC x I2C0-scFc VH CDR3
GAYTYGFDY

SEQ ID NO: 201 - protein, 11 aa, Artificial Sequence
  Synthetic Polypeptide
  MISC_FEATURE: MU 7-G6 CC x I2C0-scFc VL CDR1
RASQSINRYLA

SEQ ID NO: 202 - protein, 7 aa, Artificial Sequence
  Synthetic Polypeptide
  MISC_FEATURE: MU 7-G6 CC x I2C0-scFc VL CDR2
TASNRAT

SEQ ID NO: 203 - protein, 9 aa, Artificial Sequence
  Synthetic Polypeptide
  MISC_FEATURE: MU 7-G6 CC x I2C0-scFc VL CDR3
HHYGSSIFT

SEQ ID NO: 204 - protein, 118 aa, Artificial Sequence
  Synthetic Polypeptide
  MISC_FEATURE: MU 7-G6 CC x I2C0-scFc VH
QVQLVESGGGVVKPGGSLRLSCAASGFTFSSYGMHWVRQAPGKCLEWVAVIWYSGSNKYYATSVKGRFTISRDNSKNTLYLQMNNLRAEDTAVYYCARGAYTYGFDYWGQGTLVTVSS

SEQ ID NO: 205 - protein, 107 aa, Artificial Sequence
  Synthetic Polypeptide
  MISC_FEATURE: MU 7-G6 CC x I2C0-scFc VL
EIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 206 - protein, 240 aa, Artificial Sequence
  Synthetic Polypeptide
  MISC_FEATURE: MU 7-G6 CC x I2C0-scFc scFv
QVQLVESGGGVVKPGGSLRLSCAASGFTFSSYGMHWVRQAPGKCLEWVAVIWYSGSNKYYATSVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 207 - protein, 495 aa, Artificial Sequence
  Synthetic Polypeptide
  MISC_FEATURE: MU 7-G6 CC x I2C0-scFc Bispecific molecule
QVQLVESGGGVVKPGGSLRLSCAASGFTFSSYGMHWVRQAPGKCLEWVAVIWYSGSNKYYATSVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 208 - protein, 983 aa, Artificial Sequence
  Synthetic Polypeptide
  MISC_FEATURE: MU 7-G6 CC x I2C0-scFc Bispecific HLE molecule
QVQLVESGGGVVKPGGSLRLSCAASGFTFSSYGMHWVRQAPGKCLEWVAVIWYSGSNKYYATSVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 209 - protein, 5 aa, Artificial Sequence
  Synthetic Polypeptide
  MISC_FEATURE: MU 6-B12 CC x I2C0-scFc VH CDR1
SYGMH

SEQ ID NO: 210 - protein, 17 aa, Artificial Sequence
  Synthetic Polypeptide
  MISC_FEATURE: MU 6-B12 CC x I2C0-scFc VH CDR2
VIWFDASNKYYAESVKG

SEQ ID NO: 211 - protein, 9 aa, Artificial Sequence
  Synthetic Polypeptide
  MISC_FEATURE: MU 6-B12 CC x I2C0-scFc VH CDR3
GAYTYGFDY

SEQ ID NO: 212 - protein, 11 aa, Artificial Sequence
  Synthetic Polypeptide
  MISC_FEATURE: MU 6-B12 CC x I2C0-scFc VL CDR1
RASQSINRYLA

SEQ ID NO: 213 - protein, 7 aa, Artificial Sequence
  Synthetic Polypeptide
  MISC_FEATURE: MU 6-B12 CC x I2C0-scFc VL CDR2
TASNRAT

SEQ ID NO: 214 - protein, 9 aa, Artificial Sequence
  Synthetic Polypeptide
  MISC_FEATURE: MU 6-B12 CC x I2C0-scFc VL CDR3
HHYGSSIFT

SEQ ID NO: 215 - protein, 118 aa, Artificial Sequence
  Synthetic Polypeptide
  MISC_FEATURE: MU 6-B12 CC x I2C0-scFc VH
QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSS

SEQ ID NO: 216 - protein, 107 aa, Artificial Sequence; identical to SEQ ID NO: 205
  Synthetic Polypeptide
  MISC_FEATURE: MU 6-B12 CC x I2C0-scFc VL

SEQ ID NO: 217 - protein, 240 aa, Artificial Sequence
  Synthetic Polypeptide
  MISC_FEATURE: MU 6-B12 CC x I2C0-scFc scFv
QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 218 - protein, 495 aa, Artificial Sequence
  Synthetic Polypeptide
  MISC_FEATURE: MU 6-B12 CC x I2C0-scFc Bispecific molecule
QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 219 - protein, 983 aa, Artificial Sequence
  Synthetic Polypeptide
  MISC_FEATURE: MU 6-B12 CC x I2C0-scFc Bispecific HLE molecule
QVQLVESGGGVVKPGRSLRLSCAASGFTFSSYGMHWVRQAPGKCLEWVAVIWFDASNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 5 aa, Artificial Sequence
  Synthetic Polypeptide
  MISC_FEATURE: MU 5-H4 CC x I2C0-scFc VH CDR1
SYGMH

SEQ ID NO: 221 - protein, 17 aa, Artificial Sequence
  Synthetic Polypeptide
  MISC_FEATURE: MU 5-H4 CC x I2C0-scFc VH CDR2
VIWFQGSNKYYADAVKG

SEQ ID NO: 222 - protein, 9 aa, Artificial Sequence
  Synthetic Polypeptide
  MISC_FEATURE: MU 5-H4 CC x I2C0-scFc VH CDR3
GGYTYGFDY

SEQ ID NO: 223 - protein, 11 aa, Artificial Sequence
  Synthetic Polypeptide
  MISC_FEATURE: MU 5-H4 CC x I2C0-scFc VL CDR1
RASQSINRYLA

SEQ ID NO: 224 - protein, 7 aa, Artificial Sequence
  Synthetic Polypeptide
  MISC_FEATURE: MU 5-H4 CC x I2C0-scFc VL CDR2
TASNRAT

SEQ ID NO: 225 - protein, 9 aa, Artificial Sequence
  Synthetic Polypeptide
  MISC_FEATURE: MU 5-H4 CC x I2C0-scFc VL CDR3
HHYGSSIFT

SEQ ID NO: 226 - protein, 118 aa, Artificial Sequence
  Synthetic Polypeptide
  MISC_FEATURE: MU 5-H4 CC x I2C0-scFc VH
QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSS

SEQ ID NO: 227 - protein, 107 aa, Artificial Sequence; identical to SEQ ID NO: 205
  Synthetic Polypeptide
  MISC_FEATURE: MU 5-H4 CC x I2C0-scFc VL

SEQ ID NO: 228 - protein, 240 aa, Artificial Sequence
  Synthetic Polypeptide
  MISC_FEATURE: MU 5-H4 CC x I2C0-scFc scFv
QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 229 - protein, 495 aa, Artificial Sequence
  Synthetic Polypeptide
  MISC_FEATURE: MU 5-H4 CC x I2C0-scFc Bispecific molecule
QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 230 - protein, 983 aa, Artificial Sequence
  Synthetic Polypeptide
  MISC_FEATURE: MU 5-H4 CC x I2C0-scFc Bispecific HLE molecule
QVQLVESGGGLVQPGGSLRLSCAASGFTFSSYGMHWVRQAPGKCLEWVAVIWFQGSNKYYADAVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 231 - protein, 7 aa, Artificial Sequence
  Synthetic Polypeptide
  MISC_FEATURE: MU 5-H1 CC x I2C0-scFc VH CDR1
SGGYNWA

SEQ ID NO: 232 - protein, 16 aa, Artificial Sequence
  Synthetic Polypeptide
  MISC_FEATURE: MU 5-H1 CC x I2C0-scFc VH CDR2
YIYYSGSTYYNPSLKS

SEQ ID NO: 233 - protein, 12 aa, Artificial Sequence
  Synthetic Polypeptide
  MISC_FEATURE: MU 5-H1 CC x I2C0-scFc VH CDR3
EKYSSRWTFFDY

SEQ ID NO: 234 - protein, 11 aa, Artificial Sequence
  Synthetic Polypeptide
  MISC_FEATURE: MU 5-H1 CC x I2C0-scFc VL CDR1
SGDKLGDNYAS

SEQ ID NO: 235 - protein, 7 aa, Artificial Sequence
  Synthetic Polypeptide
  MISC_FEATURE: MU 5-H1 CC x I2C0-scFc VL CDR2
HDNKRPS

SEQ ID NO: 236 - protein, 9 aa, Artificial Sequence
  Synthetic Polypeptide
  MISC_FEATURE: MU 5-H1 CC x I2C0-scFc VL CDR3
QAFQSSTVV

SEQ ID NO: 237 - protein, 122 aa, Artificial Sequence
  Synthetic Polypeptide
  MISC_FEATURE: MU 5-H1 CC x I2C0-scFc VH
QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSS

SEQ ID NO: 238 - protein, 106 aa, Artificial Sequence
  Synthetic Polypeptide
  MISC_FEATURE: MU 5-H1 CC x I2C0-scFc VL
SYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVL

SEQ ID NO: 239 - protein, 243 aa, Artificial Sequence
  Synthetic Polypeptide
  MISC_FEATURE: MU 5-H1 CC x I2C0-scFc scFv
QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSSGGGGSGGGGSGGGGSSYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVL

SEQ ID NO: 240 - protein, 498 aa, Artificial Sequence
  Synthetic Polypeptide
  MISC_FEATURE: MU 5-H1 CC x I2C0-scFc Bispecific molecule
QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSSGGGGSGGGGSGGGGSSYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 241 - protein, 986 aa, Artificial Sequence
  Synthetic Polypeptide
  MISC_FEATURE: MU 5-H1 CC x I2C0-scFc Bispecific HLE molecule
QVQLQESGPGLVKPSETLSLTCTVSGDSISSGGYNWAWIRQHPGKCLEWIGYIYYSGSTYYNPSLKSRVTISVDTSKNQFSLKLSSVTAADTAVYYCAREKYSSRWTFFDYWGQGTLVTVSSGGGGSGGGGSGGGGSSYELTQPPSVSVSPGQTASITCSGDKLGDNYASWYQQKPGQSPVLVIYHDNKRPSGIPERFSGSNSGNTATLTISGTQAMDEADYYCQAFQSSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 5 aa, Artificial Sequence
  Synthetic Polypeptide
  MISC_FEATURE: MU 4-H11 CC x I2C0-scFc VH CDR1
NFGMH

SEQ ID NO: 243 - protein, 17 aa, Artificial Sequence
  Synthetic Polypeptide
  MISC_FEATURE: MU 4-H11 CC x I2C0-scFc VH CDR2
VIWFDASKTYYAEAVKG

SEQ ID NO: 244 - protein, 12 aa, Artificial Sequence
  Synthetic Polypeptide
  MISC_FEATURE: MU 4-H11 CC x I2C0-scFc VH CDR3
ATYSTGWSYFDY

SEQ ID NO: 245 - protein, 11 aa, Artificial Sequence
  Synthetic Polypeptide
  MISC_FEATURE: MU 4-H11 CC x I2C0-scFc VL CDR1
SGDKLGDKYTS

SEQ ID NO: 246 - protein, 7 aa, Artificial Sequence
  Synthetic Polypeptide
  MISC_FEATURE: MU 4-H11 CC x I2C0-scFc VL CDR2
HDAKRPS

SEQ ID NO: 247 - protein, 10 aa, Artificial Sequence
  Synthetic Polypeptide
  MISC_FEATURE: MU 4-H11 CC x I2C0-scFc VL CDR3
QAYEASTAWV

SEQ ID NO: 248 - protein, 121 aa, Artificial Sequence
  Synthetic Polypeptide
  MISC_FEATURE: MU 4-H11 CC x I2C0-scFc VH
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSS

SEQ ID NO: 249 - protein, 107 aa, Artificial Sequence
  Synthetic Polypeptide
  MISC_FEATURE: MU 4-H11 CC x I2C0-scFc VL
SYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVL

SEQ ID NO: 250 - protein, 243 aa, Artificial Sequence
  Synthetic Polypeptide
  MISC_FEATURE: MU 4-H11 CC x I2C0-scFc scFv
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVL

SEQ ID NO: 251 - protein, 498 aa, Artificial Sequence
  Synthetic Polypeptide
  MISC_FEATURE: MU 4-H11 CC x I2C0-scFc Bispecific molecule
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 252 - protein, 986 aa, Artificial Sequence
  Synthetic Polypeptide
  MISC_FEATURE: MU 4-H11 CC x I2C0-scFc Bispecific HLE molecule
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYEASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 253 - protein, 5 aa, Artificial Sequence
  Synthetic Polypeptide
  MISC_FEATURE: MU 4-H2 CC x I2C0-scFc VH CDR1
NFGMH

SEQ ID NO: 254 - protein, 17 aa, Artificial Sequence
  Synthetic Polypeptide
  MISC_FEATURE: MU 4-H2 CC x I2C0-scFc VH CDR2
VIWFDASKTYYAESVKG

SEQ ID NO: 255 - protein, 12 aa, Artificial Sequence
  Synthetic Polypeptide
  MISC_FEATURE: MU 4-H2 CC x I2C0-scFc VH CDR3
ATYSTGWSYFDY

SEQ ID NO: 256 - protein, 11 aa, Artificial Sequence
  Synthetic Polypeptide
  MISC_FEATURE: MU 4-H2 CC x I2C0-scFc VL CDR1
SGDKLGDKYTS

SEQ ID NO: 257 - protein, 7 aa, Artificial Sequence
  Synthetic Polypeptide
  MISC_FEATURE: MU 4-H2 CC x I2C0-scFc VL CDR2
HDAKRPS

SEQ ID NO: 258 - protein, 10 aa, Artificial Sequence
  Synthetic Polypeptide
  MISC_FEATURE: MU 4-H2 CC x I2C0-scFc VL CDR3
QAWEASTAWV

SEQ ID NO: 259 - protein, 121 aa, Artificial Sequence
  Synthetic Polypeptide
  MISC_FEATURE: MU 4-H2 CC x I2C0-scFc VH
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSS

SEQ ID NO: 260 - protein, 107 aa, Artificial Sequence
  Synthetic Polypeptide
  MISC_FEATURE: MU 4-H2 CC x I2C0-scFc VL
SYELTQPPSVSVSPGQTASITCSGDKLGDKYTSWYQQKPGQSPVLVIYHDAKRPSGIPERFSGSNSGNTATLTISGTQAMDEADYYCQAWEASTAWVFGCGTKLTVL

SEQ ID NO: 261 - protein, 243 aa, Artificial Sequence
  Synthetic Polypeptide
  MISC_FEATURE: MU 4-H2 CC x I2C0-scFc scFv
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWEASTAWVFGCGTKLTVL

SEQ ID NO: 262 - protein, 498 aa, Artificial Sequence
  Synthetic Polypeptide
  MISC_FEATURE: MU 4-H2 CC x I2C0-scFc Bispecific molecule
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWEASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 263 - protein, 986 aa, Artificial Sequence
  Synthetic Polypeptide
  MISC_FEATURE: MU 4-H2 CC x I2C0-scFc Bispecific HLE molecule
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWEASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 264 - protein, 5 aa, Artificial Sequence
  Synthetic Polypeptide
  MISC_FEATURE: MU 4-G4 CC x I2C0-scFc VH CDR1
NFGMH

SEQ ID NO: 265 - protein, 17 aa, Artificial Sequence
  Synthetic Polypeptide
  MISC_FEATURE: MU 4-G4 CC x I2C0-scFc VH CDR2
VIWFDASKTYYADAVKG

SEQ ID NO: 266 - protein, 12 aa, Artificial Sequence
  Synthetic Polypeptide
  MISC_FEATURE: MU 4-G4 CC x I2C0-scFc VH CDR3
ATYSTGWSYFDY

SEQ ID NO: 267 - protein, 11 aa, Artificial Sequence
  Synthetic Polypeptide
  MISC_FEATURE: MU 4-G4 CC x I2C0-scFc VL CDR1
SGDKLGDKYTS

SEQ ID NO: 268 - protein, 7 aa, Artificial Sequence
  Synthetic Polypeptide
  MISC_FEATURE: MU 4-G4 CC x I2C0-scFc VL CDR2
HDAKRPS

SEQ ID NO: 269 - protein, 10 aa, Artificial Sequence
  Synthetic Polypeptide
  MISC_FEATURE: MU 4-G4 CC x I2C0-scFc VL CDR3
QAWDASTAWV

SEQ ID NO: 270 - protein, 121 aa, Artificial Sequence
  Synthetic Polypeptide
  MISC_FEATURE: MU 4-G4 CC x I2C0-scFc VH
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSS

SEQ ID NO: 271 - protein, 107 aa, Artificial Sequence; identical to SEQ ID NO: 73
  Synthetic Polypeptide
  MISC_FEATURE: MU 4-G4 CC x I2C0-scFc VL

SEQ ID NO: 272 - protein, 243 aa, Artificial Sequence
  Synthetic Polypeptide
  MISC_FEATURE: MU 4-G4 CC x I2C0-scFc scFv
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVL

SEQ ID NO: 273 - protein, 498 aa, Artificial Sequence
  Synthetic Polypeptide
  MISC_FEATURE: MU 4-G4 CC x I2C0-scFc Bispecific molecule
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 274 - protein, 986 aa, Artificial Sequence
  Synthetic Polypeptide
  MISC_FEATURE: MU 4-G4 CC x I2C0-scFc Bispecific HLE molecule
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWDASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - protein, 5 aa, Artificial Sequence
  Synthetic Polypeptide
  MISC_FEATURE: MU 4-F6 CC x I2C0-scFc VH CDR1
NFGMH

SEQ ID NO: 276 - protein, 17 aa, Artificial Sequence
  Synthetic Polypeptide
  MISC_FEATURE: MU 4-F6 CC x I2C0-scFc VH CDR2
VIWFDASKTYYASSVKG

SEQ ID NO: 277 - protein, 12 aa, Artificial Sequence
  Synthetic Polypeptide
  MISC_FEATURE: MU 4-F6 CC x I2C0-scFc VH CDR3
ATYSTGWSYFDY

SEQ ID NO: 278 - protein, 11 aa, Artificial Sequence
  Synthetic Polypeptide
  MISC_FEATURE: MU 4-F6 CC x I2C0-scFc VL CDR1
SGDKLGDKYTS

SEQ ID NO: 279 - protein, 7 aa, Artificial Sequence
  Synthetic Polypeptide
  MISC_FEATURE: MU 4-F6 CC x I2C0-scFc VL CDR2
HDAKRPS

SEQ ID NO: 280 - protein, 10 aa, Artificial Sequence
  Synthetic Polypeptide
  MISC_FEATURE: MU 4-F6 CC x I2C0-scFc VL CDR3
QAYSASTAWV

SEQ ID NO: 281 - protein, 121 aa, Artificial Sequence; identical to SEQ ID NO: 72
  Synthetic Polypeptide
  MISC_FEATURE: MU 4-F6 CC x I2C0-scFc VH

SEQ ID NO: 282 - protein, 107 aa, Artificial Sequence
  Synthetic Polypeptide
  MISC_FEATURE: MU 4-F6 CC x I2C0-scFc VL
SYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVL

SEQ ID NO: 283 - protein, 243 aa, Artificial Sequence
  Synthetic Polypeptide
  MISC_FEATURE: MU 4-F6 CC x I2C0-scFc scFv
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVL

SEQ ID NO: 284 - protein, 498 aa, Artificial Sequence
  Synthetic Polypeptide
  MISC_FEATURE: MU 4-F6 CC x I2C0-scFc Bispecific molecule
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 285 - protein, 986 aa, Artificial Sequence
  Synthetic Polypeptide
  MISC_FEATURE: MU 4-F6 CC x I2C0-scFc Bispecific HLE molecule
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAYSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 286 - protein, 5 aa, Artificial Sequence
  Synthetic Polypeptide
  MISC_FEATURE: MU 4-E7 CC x I2C0-scFc VH CDR1
GYYWS

SEQ ID NO: 287 - protein, 16 aa, Artificial Sequence
  Synthetic Polypeptide
  MISC_FEATURE: MU 4-E7 CC x I2C0-scFc VH CDR2
DIDYSGSTKYNPSLKS

SEQ ID NO: 288 - protein, 12 aa, Artificial Sequence
  Synthetic Polypeptide
  MISC_FEATURE: MU 4-E7 CC x I2C0-scFc VH CDR3
KKYSTVWSYFDY

SEQ ID NO: 289 - protein, 11 aa, Artificial Sequence
  Synthetic Polypeptide
  MISC_FEATURE: MU 4-E7 CC x I2C0-scFc VL CDR1
SGDKLGEKYAS

SEQ ID NO: 290 - protein, 7 aa, Artificial Sequence
  Synthetic Polypeptide
  MISC_FEATURE: MU 4-E7 CC x I2C0-scFc VL CDR2
QDRKRPS

SEQ ID NO: 291 - protein, 9 aa, Artificial Sequence
  Synthetic Polypeptide
  MISC_FEATURE: MU 4-E7 CC x I2C0-scFc VL CDR3
QAWGSSAAV

SEQ ID NO: 292 - protein, 120 aa, Artificial Sequence
  Synthetic Polypeptide
  MISC_FEATURE: MU 4-E7 CC x I2C0-scFc VH
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSS

SEQ ID NO: 293 - protein, 106 aa, Artificial Sequence
  Synthetic Polypeptide
  MISC_FEATURE: MU 4-E7 CC x I2C0-scFc VL
SYELTQPSSVSVSPGQTASITCSGDKLGEKYASWYQQKPGQSPVLIIYQDRKRPSGVPERFSGSNSGNTATLTISGTQAMDEADYYCQAWGSSAAVFGCGTKLTVL

SEQ ID NO: 294 - protein, 241 aa, Artificial Sequence
  Synthetic Polypeptide
  MISC_FEATURE: MU 4-E7 CC x I2C0-scFc scFv
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGEKYASWYQQKPGQSPVLIIYQDRKRPSGVPERFSGSNSGNTATLTISGTQAMDEADYYCQAWGSSAAVFGCGTKLTVL

SEQ ID NO: 295 - protein, 496 aa, Artificial Sequence
  Synthetic Polypeptide
  MISC_FEATURE: MU 4-E7 CC x I2C0-scFc Bispecific molecule
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGEKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 296 - protein, 984 aa, Artificial Sequence
  Synthetic Polypeptide
  MISC_FEATURE: MU 4-E7 CC x I2C0-scFc Bispecific HLE molecule
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGEKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 5 aa, Artificial Sequence
  Synthetic Polypeptide
  MISC_FEATURE: MU 4-C11 CC x I2C0-scFc VH CDR1
SYGMH

SEQ ID NO: 298 - protein, 17 aa, Artificial Sequence
  Synthetic Polypeptide
  MISC_FEATURE: MU 4-C11 CC x I2C0-scFc VH CDR2
VISYDASNKYYASAVKG

SEQ ID NO: 299 - protein, 9 aa, Artificial Sequence
  Synthetic Polypeptide
  MISC_FEATURE: MU 4-C11 CC x I2C0-scFc VH CDR3
GAYTYGFDY

SEQ ID NO: 300 - protein, 11 aa, Artificial Sequence
  Synthetic Polypeptide
  MISC_FEATURE: MU 4-C11 CC x I2C0-scFc VL CDR1
RASQSVNRYLA

SEQ ID NO: 301 - protein, 7 aa, Artificial Sequence
  Synthetic Polypeptide
  MISC_FEATURE: MU 4-C11 CC x I2C0-scFc VL CDR2
GASNRAT

SEQ ID NO: 302 - protein, 9 aa, Artificial Sequence
  Synthetic Polypeptide
  MISC_FEATURE: MU 4-C11 CC x I2C0-scFc VL CDR3
HHYGSSIFA

SEQ ID NO: 303 - protein, 118 aa, Artificial Sequence
  Synthetic Polypeptide
  MISC_FEATURE: MU 4-C11 CC x I2C0-scFc VH
QVQLVESGGGVVQPGRSLRLSCAASGFTFSSYGMHWVRQAPGKCLEWVAVISYDASNKYYASAVKGRFTISRDNSKNTLYLQMNSLRAEDTAVYYCARGAYTYGFDYWGQGTLVTVSS

SEQ ID NO: 304 - protein, 107 aa, Artificial Sequence; identical to SEQ ID NO: 40
  Synthetic Polypeptide
  MISC_FEATURE: MU 4-C11 CC x I2C0-scFc VL

SEQ ID NO: 305 - protein, 240 aa, Artificial Sequence
  Synthetic Polypeptide
  MISC_FEATURE: MU 4-C11 CC x I2C0-scFc scFv
QVQLVESGGGVVQPGRSLRLSCAASGFTFSSYGMHWVRQAPGKCLEWVAVISYDASNKYYASAVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 306 - protein, 495 aa, Artificial Sequence
  Synthetic Polypeptide
  MISC_FEATURE: MU 4-C11 CC x I2C0-scFc Bispecific molecule
QVQLVESGGGVVQPGRSLRLSCAASGFTFSSYGMHWVRQAPGKCLEWVAVISYDASNKYYASAVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 307 - protein, 983 aa, Artificial Sequence
  Synthetic Polypeptide
  MISC_FEATURE: MU 4-C11 CC x I2C0-scFc Bispecific HLE molecule
QVQLVESGGGVVQPGRSLRLSCAASGFTFSSYGMHWVRQAPGKCLEWVAVISYDASNKYYASAVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 308 - protein, 5 aa, Artificial Sequence
  Synthetic Polypeptide
  MISC_FEATURE: MU 4-C4 CC x I2C0-scFc VH CDR1
SYGMH

SEQ ID NO: 309 - protein, 17 aa, Artificial Sequence
  Synthetic Polypeptide
  MISC_FEATURE: MU 4-C4 CC x I2C0-scFc VH CDR2
VIWFDASNKYYAESVKG

SEQ ID NO: 310 - protein, 9 aa, Artificial Sequence
  Synthetic Polypeptide
  MISC_FEATURE: MU 4-C4 CC x I2C0-scFc VH CDR3
GAYTYGFDY

SEQ ID NO: 311 - protein, 11 aa, Artificial Sequence
  Synthetic Polypeptide
  MISC_FEATURE: MU 4-C4 CC x I2C0-scFc VL CDR1
RASQSVNRYLA

SEQ ID NO: 312 - protein, 7 aa, Artificial Sequence
  Synthetic Polypeptide
  MISC_FEATURE: MU 4-C4 CC x I2C0-scFc VL CDR2
GASNRAT

SEQ ID NO: 313 - protein, 9 aa, Artificial Sequence
  Synthetic Polypeptide
  MISC_FEATURE: MU 4-C4 CC x I2C0-scFc VL CDR3
HHYGSSIFA

SEQ ID NO: 314 - protein, 118 aa, Artificial Sequence
  Synthetic Polypeptide
  MISC_FEATURE: MU 4-C4 CC x I2C0-scFc VH
QVQLVESGGGVVQPGRSLRLSCAASGFTFSSYGMHWVRQAPGKCLEWVAVIWFDASNKYYAESVKGRFTISRDNSKNTLYLQMNSLRAEDTAVYYCARGAYTYGFDYWGQGTLVTVSS

SEQ ID NO: 315 - protein, 107 aa, Artificial Sequence; identical to SEQ ID NO: 40
  Synthetic Polypeptide
  MISC_FEATURE: MU 4-C4 CC x I2C0-scFc VL

SEQ ID NO: 316 - protein, 240 aa, Artificial Sequence
  Synthetic Polypeptide
  MISC_FEATURE: MU 4-C4 CC x I2C0-scFc scFv
QVQLVESGGGVVQPGRSLRLSCAASGFTFSSYGMHWVRQAPGKCLEWVAVIWFDASNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 317 - protein, 495 aa, Artificial Sequence
  Synthetic Polypeptide
  MISC_FEATURE: MU 4-C4 CC x I2C0-scFc Bispecific molecule
QVQLVESGGGVVQPGRSLRLSCAASGFTFSSYGMHWVRQAPGKCLEWVAVIWFDASNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 318 - protein, 983 aa, Artificial Sequence
  Synthetic Polypeptide
  MISC_FEATURE: MU 4-C4 CC x I2C0-scFc Bispecific HLE molecule
QVQLVESGGGVVQPGRSLRLSCAASGFTFSSYGMHWVRQAPGKCLEWVAVIWFDASNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 319 - protein, 5 aa, Artificial Sequence
  Synthetic Polypeptide
  MISC_FEATURE: MU 4-C3 CC x I2C0-scFc VH CDR1
SYGMH

SEQ ID NO: 320 - protein, 17 aa, Artificial Sequence
  Synthetic Polypeptide
  MISC_FEATURE: MU 4-C3 CC x I2C0-scFc VH CDR2
VISYEGSNKYYAESVKG

SEQ ID NO: 321 - protein, 9 aa, Artificial Sequence
  Synthetic Polypeptide
  MISC_FEATURE: MU 4-C3 CC x I2C0-scFc VH CDR3
GAYTYGFDY

SEQ ID NO: 322 - protein, 11 aa, Artificial Sequence
  Synthetic Polypeptide
  MISC_FEATURE: MU 4-C3 CC x I2C0-scFc VL CDR1
RASQSVNRYLA

SEQ ID NO: 323 - protein, 7 aa, Artificial Sequence
  Synthetic Polypeptide
  MISC_FEATURE: MU 4-C3 CC x I2C0-scFc VL CDR2
GASNRAT

SEQ ID NO: 324 - protein, 9 aa, Artificial Sequence
  Synthetic Polypeptide
  MISC_FEATURE: MU 4-C3 CC x I2C0-scFc VL CDR3
HHYGSSIFA

SEQ ID NO: 325 - protein, 118 aa, Artificial Sequence
  Synthetic Polypeptide
  MISC_FEATURE: MU 4-C3 CC x I2C0-scFc VH
QVQLVESGGGVVQPGRSLRLSCAASGFTFSSYGMHWVRQAPGKCLEWVAVISYEGSNKYYAESVKGRFTISRDNSKNTLYLQMNSLRAEDTAVYYCARGAYTYGFDYWGQGTLVTVSS

SEQ ID NO: 326 - protein, 107 aa, Artificial Sequence; identical to SEQ ID NO: 40
  Synthetic Polypeptide
  MISC_FEATURE: MU 4-C3 CC x I2C0-scFc VL

SEQ ID NO: 327 - protein, 240 aa, Artificial Sequence
  Synthetic Polypeptide
  MISC_FEATURE: MU 4-C3 CC x I2C0-scFc
QVQLVESGGGVVQPGRSLRLSCAASGFTFSSYGMHWVRQAPGKCLEWVAVISYEGSNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 328 - protein, 495 aa, Artificial Sequence
  Synthetic Polypeptide
  MISC_FEATURE: MU 4-C3 CC x I2C0-scFc Bispecific molecule
QVQLVESGGGVVQPGRSLRLSCAASGFTFSSYGMHWVRQAPGKCLEWVAVISYEGSNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 329 - protein, 983 aa, Artificial Sequence
  Synthetic Polypeptide
  MISC_FEATURE: MU 4-C3 CC x I2C0-scFc Bispecific HLE molecule
QVQLVESGGGVVQPGRSLRLSCAASGFTFSSYGMHWVRQAPGKCLEWVAVISYEGSNKYYAESVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 330 - protein, 5 aa, Artificial Sequence
  Synthetic Polypeptide
  MISC_FEATURE: MU 4-B10 CC x I2C0-scFc VH CDR1
NFGMH

SEQ ID NO: 331 - protein, 17 aa, Artificial Sequence
  Synthetic Polypeptide
  MISC_FEATURE: MU 4-B10 CC x I2C0-scFc VH CDR2
VIWFDASKTYYASSVKG

SEQ ID NO: 332 - protein, 12 aa, Artificial Sequence
  Synthetic Polypeptide
  MISC_FEATURE: MU 4-B10 CC x I2C0-scFc VH CDR3
ATYSTGWSYFDY

SEQ ID NO: 333 - protein, 11 aa, Artificial Sequence
  Synthetic Polypeptide
  MISC_FEATURE: MU 4-B10 CC x I2C0-scFc VL CDR1
SGDKLGDKYTS

SEQ ID NO: 334 - protein, 7 aa, Artificial Sequence
  Synthetic Polypeptide
  MISC_FEATURE: MU 4-B10 CC x I2C0-scFc VL CDR2
HDAKRPS

SEQ ID NO: 335 - protein, 10 aa, Artificial Sequence
  Synthetic Polypeptide
  MISC_FEATURE: MU 4-B10 CC x I2C0-scFc VL CDR3
QAWSASTAWV

SEQ ID NO: 336 - protein, 121 aa, Artificial Sequence; identical to SEQ ID NO: 72
  Synthetic Polypeptide
  MISC_FEATURE: MU 4-B10 CC x I2C0-scFc VH

SEQ ID NO: 337 - protein, 107 aa, Artificial Sequence
  Synthetic Polypeptide
  MISC_FEATURE: MU 4-B10 CC x I2C0-scFc VL
SYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL

SEQ ID NO: 338 - protein, 243 aa, Artificial Sequence
  Synthetic Polypeptide
  MISC_FEATURE: MU 4-B10 CC x I2C0-scFc scFv
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL

SEQ ID NO: 339 - protein, 498 aa, Artificial Sequence
  Synthetic Polypeptide
  MISC_FEATURE: MU 4-B10 CC x I2C0-scFc Bispecific molecule
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 340 - protein, 986 aa, Artificial Sequence
  Synthetic Polypeptide
  MISC_FEATURE: MU 4-B10 CC x I2C0-scFc Bispecific HLE molecule
QVQLVESGGGVVQPGRSLRLSCAASGFTFSNFGMHWVRQAPGKCLEWVAVIWFDASKTYYASSVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 341 - protein, 5 aa, Artificial Sequence
  Synthetic Polypeptide
  MISC_FEATURE: MU 4-B6 CC x I2C0-scFc VH CDR1
SYGMH

SEQ ID NO: 342 - protein, 17 aa, Artificial Sequence
  Synthetic Polypeptide
  MISC_FEATURE: MU 4-B6 CC x I2C0-scFc VH CDR2
VISYDASNKYYASSVKG

SEQ ID NO: 343 - protein, 9 aa, Artificial Sequence
  Synthetic Polypeptide
  MISC_FEATURE: MU 4-B6 CC x I2C0-scFc VH CDR3
GAYTYGFDY

SEQ ID NO: 344 - protein, 11 aa, Artificial Sequence
  Synthetic Polypeptide
  MISC_FEATURE: MU 4-B6 CC x I2C0-scFc VL CDR1
RASQSVNRYLA

SEQ ID NO: 345 - protein, 7 aa, Artificial Sequence
  Synthetic Polypeptide
  MISC_FEATURE: MU 4-B6 CC x I2C0-scFc VL CDR2
GASNRAT

SEQ ID NO: 346 - protein, 9 aa, Artificial Sequence
  Synthetic Polypeptide
  MISC_FEATURE: MU 4-B6 CC x I2C0-scFc VL CDR3
HHYGSSIFA

SEQ ID NO: 347 - protein, 118 aa, Artificial Sequence
  Synthetic Polypeptide
  MISC_FEATURE: MU 4-B6 CC x I2C0-scFc VH
QVQLVESGGGVVQPGRSLRLSCAASGFTFSSYGMHWVRQAPGKCLEWVAVISYDASNKYYASSVKGRFTISRDNSKNTLYLQMNSLRAEDTAVYYCARGAYTYGFDYWGQGTLVTVSS

SEQ ID NO: 348 - protein, 107 aa, Artificial Sequence; identical to SEQ ID NO: 40
  Synthetic Polypeptide
  MISC_FEATURE: MU 4-B6 CC x I2C0-scFc VL

SEQ ID NO: 349 - protein, 240 aa, Artificial Sequence
  Synthetic Polypeptide
  MISC_FEATURE: MU 4-B6 CC x I2C0-scFc scFv
QVQLVESGGGVVQPGRSLRLSCAASGFTFSSYGMHWVRQAPGKCLEWVAVISYDASNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIK

SEQ ID NO: 350 - protein, 495 aa, Artificial Sequence
  Synthetic Polypeptide
  MISC_FEATURE: MU 4-B6 CC x I2C0-scFc Bispecific molecule
QVQLVESGGGVVQPGRSLRLSCAASGFTFSSYGMHWVRQAPGKCLEWVAVISYDASNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 351 - protein, 983 aa, Artificial Sequence
  Synthetic Polypeptide
  MISC_FEATURE: MU 4-B6 CC x I2C0-scFc Bispecific HLE molecule
QVQLVESGGGVVQPGRSLRLSCAASGFTFSSYGMHWVRQAPGKCLEWVAVISYDASNKYYASSVKGRFTISRDNSKNTLYLQMNSLRAEDTAVYYCARGAYTYGFDYWGQGTLVTVSSGGGGSGGGGSGGGGSEIVLTQSPGTLSLSPGERATLSCRASQSVNRYLAWYQQKPGQAPRLLIYGASNRATGIPDRFTGSGSGTDFTLTISRLEPEDFAVYFCHHYGSSIFAFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 352 - protein, 5 aa, Artificial Sequence
  Synthetic Polypeptide
  MISC_FEATURE: MU 4-B1 CC x I2C0-scFc VH CDR1
NFGMH

SEQ ID NO: 353 - protein, 17 aa, Artificial Sequence
  Synthetic Polypeptide
  MISC_FEATURE: MU 4-B1 CC x I2C0-scFc VH CDR2
VIWFDASKTYYAESVKG

SEQ ID NO: 354 - protein, 12 aa, Artificial Sequence
  Synthetic Polypeptide
  MISC_FEATURE: MU 4-B1 CC x I2C0-scFc VH CDR3
ATYSTGWSYFDY

SEQ ID NO: 355 - protein, 11 aa, Artificial Sequence
  Synthetic Polypeptide
  MISC_FEATURE: MU 4-B1 CC x I2C0-scFc VL CDR1
SGDKLGDKYTS

SEQ ID NO: 356 - protein, 7 aa, Artificial Sequence
  Synthetic Polypeptide
  MISC_FEATURE: MU 4-B1 CC x I2C0-scFc VL CDR2
HDAKRPS

SEQ ID NO: 357 - protein, 10 aa, Artificial Sequence
  Synthetic Polypeptide
  MISC_FEATURE: MU 4-B1 CC x I2C0-scFc VL CDR3
QAWSASTAWV

SEQ ID NO: 358 - protein, 121 aa, Artificial Sequence; identical to SEQ ID NO: 259
  Synthetic Polypeptide
  MISC_FEATURE: MU 4-B1 CC x I2C0-scFc VH

SEQ ID NO: 359 - protein, 107 aa, Artificial Sequence; identical to SEQ ID NO: 337
  Synthetic Polypeptide
  MISC_FEATURE: MU 4-B1 CC x I2C0-scFc VL

SEQ ID NO: 360 - protein, 243 aa, Artificial Sequence
  Synthetic Polypeptide
  MISC_FEATURE: MU 4-B1 CC x I2C0-scFc scFv
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL

SEQ ID NO: 361 - protein, 498 aa, Artificial Sequence
  Synthetic Polypeptide
  MISC_FEATURE: MU 4-B1 CC x I2C0-scFc Bispecific molecule
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 362 - protein, 986 aa, Artificial Sequence
  Synthetic Polypeptide
  MISC_FEATURE: MU 4-B1 CC x I2C0-scFc Bispecific HLE molecule
QVQLVESGGGVVQPGRSLRLSCAASGFTFSNFGMHWVRQAPGKCLEWVAVIWFDASKTYYAESVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 363 - protein, 5 aa, Artificial Sequence
  Synthetic Polypeptide
  MISC_FEATURE: MU 4-A8 CC x I2C0-scFc VH CDR1
NFGMH

SEQ ID NO: 364 - protein, 17 aa, Artificial Sequence
  Synthetic Polypeptide
  MISC_FEATURE: MU 4-A8 CC x I2C0-scFc VH CDR2
VIWFDASKTYYADAVKG

SEQ ID NO: 365 - protein, 12 aa, Artificial Sequence
  Synthetic Polypeptide
  MISC_FEATURE: MU 4-A8 CC x I2C0-scFc VH CDR3
ATYSTGWSYFDY

SEQ ID NO: 366 - protein, 11 aa, Artificial Sequence
  Synthetic Polypeptide
  MISC_FEATURE: MU 4-A8 CC x I2C0-scFc VL CDR1
SGDKLGDKYTS

SEQ ID NO: 367 - protein, 7 aa, Artificial Sequence
  Synthetic Polypeptide
  MISC_FEATURE: MU 4-A8 CC x I2C0-scFc VL CDR2
HDAKRPS

SEQ ID NO: 368 - protein, 10 aa, Artificial Sequence
  Synthetic Polypeptide
  MISC_FEATURE: MU 4-A8 CC x I2C0-scFc VL CDR3
QAWSASTAWV

SEQ ID NO: 369 - protein, 121 aa, Artificial Sequence; identical to SEQ ID NO: 270
  Synthetic Polypeptide
  MISC_FEATURE: MU 4-A8 CC x I2C0-scFc VH

SEQ ID NO: 370 - protein, 107 aa, Artificial Sequence; identical to SEQ ID NO: 337
  Synthetic Polypeptide
  MISC_FEATURE: MU 4-A8 CC x I2C0-scFc VL

SEQ ID NO: 371 - protein, 243 aa, Artificial Sequence
  Synthetic Polypeptide
  MISC_FEATURE: MU 4-A8 CC x I2C0-scFc scFv
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL

SEQ ID NO: 372 - protein, 498 aa, Artificial Sequence
  Synthetic Polypeptide
  MISC_FEATURE: MU 4-A8 CC x I2C0-scFc Bispecific molecule
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 373 - protein, 986 aa, Artificial Sequence
  Synthetic Polypeptide
  MISC_FEATURE: MU 4-A8 CC x I2C0-scFc Bispecific HLE molecule
QVQLVESGGGVVQPGRSLRLSCAASGFTFSNFGMHWVRQAPGKCLEWVAVIWFDASKTYYADAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 374 - protein, 5 aa, Artificial Sequence
  Synthetic Polypeptide
  MISC_FEATURE: MU 3-C10 CC x I2C0-scFc VH CDR1
SYGMH

SEQ ID NO: 375 - protein, 17 aa, Artificial Sequence
  Synthetic Polypeptide
  MISC_FEATURE: MU 3-C10 CC x I2C0-scFc VH CDR2
VIWYSGSNKYYATSVKG

SEQ ID NO: 376 - protein, 9 aa, Artificial Sequence
  Synthetic Polypeptide
  MISC_FEATURE: MU 3-C10 CC x I2C0-scFc VH CDR3
GGYTYGFDY

SEQ ID NO: 377 - protein, 11 aa, Artificial Sequence
  Synthetic Polypeptide
  MISC_FEATURE: MU 3-C10 CC x I2C0-scFc VL CDR1
RASQSINRYLA

SEQ ID NO: 378 - protein, 7 aa, Artificial Sequence
  Synthetic Polypeptide
  MISC_FEATURE: MU 3-C10 CC x I2C0-scFc VL CDR2
TASNRAT

SEQ ID NO: 379 - protein, 9 aa, Artificial Sequence
  Synthetic Polypeptide
  MISC_FEATURE: MU 3-C10 CC x I2C0-scFc VL CDR3
HHYGSSIFT

SEQ ID NO: 380 - protein, 118 aa, Artificial Sequence
  Synthetic Polypeptide
  MISC_FEATURE: MU 3-C10 CC x I2C0-scFc VH
QVQLVESGGGVVKPGRSLRLSCAASGFTFSSYGMHWVRQAPGKCLEWVAVIWYSGSNKYYATSVKGRFTISRDNSKNTLYLQMNNLRAEDTAVYYCARGGYTYGFDYWGQGTLVTVSS

SEQ ID NO: 381 - protein, 107 aa, Artificial Sequence; identical to SEQ ID NO: 205
  Synthetic Polypeptide
  MISC_FEATURE: MU 3-C10 CC x I2C0-scFc VL

SEQ ID NO: 382 - protein, 240 aa, Artificial Sequence
  Synthetic Polypeptide
  MISC_FEATURE: MU 3-C10 CC x I2C0-scFc scFv
QVQLVESGGGVVKPGRSLRLSCAASGFTFSSYGMHWVRQAPGKCLEWVAVIWYSGSNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 383 - protein, 495 aa, Artificial Sequence
  Synthetic Polypeptide
  MISC_FEATURE: MU 3-C10 CC x I2C0-scFc Bispecific molecule
QVQLVESGGGVVKPGRSLRLSCAASGFTFSSYGMHWVRQAPGKCLEWVAVIWYSGSNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 384 - protein, 983 aa, Artificial Sequence
  Synthetic Polypeptide
  MISC_FEATURE: MU 3-C10 CC x I2C0-scFc Bispecific HLE molecule
QVQLVESGGGVVKPGRSLRLSCAASGFTFSSYGMHWVRQAPGKCLEWVAVIWYSGSNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 385 - protein, 5 aa, Artificial Sequence
  Synthetic Polypeptide
  MISC_FEATURE: MU 2-F7 CC x I2C0-scFc VH CDR1
SYGMH

SEQ ID NO: 386 - protein, 17 aa, Artificial Sequence
  Synthetic Polypeptide
  MISC_FEATURE: MU 2-F7 CC x I2C0-scFc VH CDR2
VIWFDASNKYYAESVKG

SEQ ID NO: 387 - protein, 9 aa, Artificial Sequence
  Synthetic Polypeptide
  MISC_FEATURE: MU 2-F7 CC x I2C0-scFc VH CDR3
GGYTYGFDY

SEQ ID NO: 388 - protein, 11 aa, Artificial Sequence
  Synthetic Polypeptide
  MISC_FEATURE: MU 2-F7 CC x I2C0-scFc VL CDR1
RASQSINRYLA

SEQ ID NO: 389 - protein, 7 aa, Artificial Sequence
  Synthetic Polypeptide
  MISC_FEATURE: MU 2-F7 CC x I2C0-scFc VL CDR2
TASNRAT

SEQ ID NO: 390 - protein, 9 aa, Artificial Sequence
  Synthetic Polypeptide
  MISC_FEATURE: MU 2-F7 CC x I2C0-scFc VL CDR3
HHYGSSIFT

SEQ ID NO: 391 - protein, 118 aa, Artificial Sequence
  Synthetic Polypeptide
  MISC_FEATURE: MU 2-F7 CC x I2C0-scFc VH
QVQLVESGGGLVKPGGSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSS

SEQ ID NO: 392 - protein, 107 aa, Artificial Sequence; identical to SEQ ID NO: 205
  Synthetic Polypeptide
  MISC_FEATURE: MU 2-F7 CC x I2C0-scFc VL

SEQ ID NO: 393 - protein, 240 aa, Artificial Sequence
  Synthetic Polypeptide
  MISC_FEATURE: MU 2-F7 CC x I2C0-scFc scFv
QVQLVESGGGLVKPGGSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 394 - protein, 495 aa, Artificial Sequence
  Synthetic Polypeptide
  MISC_FEATURE: MU 2-F7 CC x I2C0-scFc Bispecific molecule
QVQLVESGGGLVKPGGSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 395 - protein, 983 aa, Artificial Sequence
  Synthetic Polypeptide
  MISC_FEATURE: MU 2-F7 CC x I2C0-scFc Bispecific HLE molecule
QVQLVESGGGLVKPGGSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 396 - protein, 5 aa, Artificial Sequence
  Synthetic Polypeptide
  MISC_FEATURE: MU 02-E7 CC x I2C0-scFc VH CDR1
SYGMH

SEQ ID NO: 397 - protein, 17 aa, Artificial Sequence
  Synthetic Polypeptide
  MISC_FEATURE: MU 02-E7 CC x I2C0-scFc VH CDR2
VIWYTGSNKYYAHSVKG

SEQ ID NO: 398 - protein, 9 aa, Artificial Sequence
  Synthetic Polypeptide
  MISC_FEATURE: MU 02-E7 CC x I2C0-scFc VH CDR3
GAYTYGFDY

SEQ ID NO: 399 - protein, 11 aa, Artificial Sequence
  Synthetic Polypeptide
  MISC_FEATURE: MU 02-E7 CC x I2C0-scFc VL CDR1
RASQSINRYLA

SEQ ID NO: 400 - protein, 7 aa, Artificial Sequence
  Synthetic Polypeptide
  MISC_FEATURE: MU 02-E7 CC x I2C0-scFc VL CDR2
TASNRAT

SEQ ID NO: 401 - protein, 9 aa, Artificial Sequence
  Synthetic Polypeptide
  MISC_FEATURE: MU 02-E7 CC x I2C0-scFc VL CDR3
HHYGSSIFT

SEQ ID NO: 402 - protein, 118 aa, Artificial Sequence
  Synthetic Polypeptide
  MISC_FEATURE: MU 02-E7 CC x I2C0-scFc VH
QVQLVESGGGVVQPGGSLRLSCAASGFTFSSYGMHWVRQAPGKCLEWVAVIWYTGSNKYYAHSVKGRFAISRDNSKNTLYLQMNNLRAEDTAVYYCARGAYTYGFDYWGQGTLVTVSS

SEQ ID NO: 403 - protein, 107 aa, Artificial Sequence; identical to SEQ ID NO: 205
  Synthetic Polypeptide
  MISC_FEATURE: MU 02-E7 CC x I2C0-scFc VL

SEQ ID NO: 404 - protein, 240 aa, Artificial Sequence
  Synthetic Polypeptide
  MISC_FEATURE: MU 02-E7 CC x I2C0-scFc scFv
QVQLVESGGGVVQPGGSLRLSCAASGFTFSSYGMHWVRQAPGKCLEWVAVIWYTGSNKYYAHSVKGRFAISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 405 - protein, 495 aa, Artificial Sequence
  Synthetic Polypeptide
  MISC_FEATURE: MU 02-E7 CC x I2C0-scFc Bispecific molecule
QVQLVESGGGVVQPGGSLRLSCAASGFTFSSYGMHWVRQAPGKCLEWVAVIWYTGSNKYYAHSVKGRFAISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 406 - protein, 983 aa, Artificial Sequence
  Synthetic Polypeptide
  MISC_FEATURE: MU 02-E7 CC x I2C0-scFc Bispecific HLE molecule
QVQLVESGGGVVQPGGSLRLSCAASGFTFSSYGMHWVRQAPGKCLEWVAVIWYTGSNKYYAHSVKGRFAISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 407 - protein, 5 aa, Artificial Sequence
  Synthetic Polypeptide
  MISC_FEATURE: MU 2-D11 CC x I2C0-scFc VH CDR1
NHGMH

SEQ ID NO: 408 - protein, 17 aa, Artificial Sequence
  Synthetic Polypeptide
  MISC_FEATURE: MU 2-D11 CC x I2C0-scFc VH CDR2
GIWSDASNKYYAEAVKG

SEQ ID NO: 409 - protein, 12 aa, Artificial Sequence
  Synthetic Polypeptide
  MISC_FEATURE: MU 2-D11 CC x I2C0-scFc VH CDR3
ATYTTGWSYFDY

SEQ ID NO: 410 - protein, 11 aa, Artificial Sequence
  Synthetic Polypeptide
  MISC_FEATURE: MU 2-D11 CC x I2C0-scFc VL CDR1
SGDKLGDKYTS

SEQ ID NO: 411 - protein, 7 aa, Artificial Sequence
  Synthetic Polypeptide
  MISC_FEATURE: MU 2-D11 CC x I2C0-scFc VL CDR2
HDRKRPS

SEQ ID NO: 412 - protein, 10 aa, Artificial Sequence
  Synthetic Polypeptide
  MISC_FEATURE: MU 2-D11 CC x I2C0-scFc VL CDR3
QAYDRSTAWV

SEQ ID NO: 413 - protein, 121 aa, Artificial Sequence
  Synthetic Polypeptide
  MISC_FEATURE: MU 2-D11 CC x I2C0-scFc VH
QVQLVESGGGVVQPGRSLRLSCAASGFTFSNHGMHWVRQAPGKCLEWVAGIWSDASNKYYAEAVKGRFTISRDTSKNTLYLQMNSLRAEDTAVYYCARATYTTGWSYFDYWGQGTLVTVSS

SEQ ID NO: 414 - protein, 107 aa, Artificial Sequence
  Synthetic Polypeptide
  MISC_FEATURE: MU 2-D11 CC x I2C0-scFc VL
SYELTQSPSVSVSPGQTASITCSGDKLGDKYTSWYQQKPGQSPVLVIYHDRKRPSGIPERFSGSNSGNTATLTISGTQAMDEADYYCQAYDRSTAWVFGCGTKLTVL

SEQ ID NO: 415 - protein, 243 aa, Artificial Sequence
  Synthetic Polypeptide
  MISC_FEATURE: MU 2-D11 CC x I2C0-scFc scFv
QVQLVESGGGVVQPGRSLRLSCAASGFTFSNHGMHWVRQAPGKCLEWVAGIWSDASNKYYAEAVKGRFTISRDTSKNTLYLQMNSLRAEDTAVYYCARATYTTGWSYFDYWGQGTLVTVSSGGGGSGGGGSGGGGSSYELTQSPSVSVSPGQTASITCSGDKLGDKYTSWYQQKPGQSPVLVIYHDRKRPSGIPERFSGSNSGNTATLTISGTQAMDEADYYCQAYDRSTAWVFGCGTKLTVL

SEQ ID NO: 416 - protein, 498 aa, Artificial Sequence
  Synthetic Polypeptide
  MISC_FEATURE: MU 2-D11 CC x I2C0-scFc Bispecific molecule
QVQLVESGGGVVQPGRSLRLSCAASGFTFSNHGMHWVRQAPGKCLEWVAGIWSDASNKYYAEAVKGRFTISRDTSKNTLYLQMNSLRAEDTAVYYCARATYTTGWSYFDYWGQGTLVTVSSGGGGSGGGGSGGGGSSYELTQSPSVSVSPGQTASITCSGDKLGDKYTSWYQQKPGQSPVLVIYHDRKRPSGIPERFSGSNSGNTATLTISGTQAMDEADYYCQAYDRSTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 417 - protein, 986 aa, Artificial Sequence
  Synthetic Polypeptide
  MISC_FEATURE: MU 2-D11 CC x I2C0-scFc Bispecific HLE molecule
QVQLVESGGGVVQPGRSLRLSCAASGFTFSNHGMHWVRQAPGKCLEWVAGIWSDASNKYYAEAVKGRFTISRDTSKNTLYLQMNSLRAEDTAVYYCARATYTTGWSYFDYWGQGTLVTVSSGGGGSGGGGSGGGGSSYELTQSPSVSVSPGQTASITCSGDKLGDKYTSWYQQKPGQSPVLVIYHDRKRPSGIPERFSGSNSGNTATLTISGTQAMDEADYYCQAYDRSTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 418 - protein, 5 aa, Artificial Sequence
  Synthetic Polypeptide
  MISC_FEATURE: MU 2-C2 CC x I2C0-scFc VH CDR1
NHGMH

SEQ ID NO: 419 - protein, 17 aa, Artificial Sequence
  Synthetic Polypeptide
  MISC_FEATURE: MU 2-C2 CC x I2C0-scFc VH CDR2
GIWSEGSNKYYADAVKG

SEQ ID NO: 420 - protein, 12 aa, Artificial Sequence
  Synthetic Polypeptide
  MISC_FEATURE: MU 2-C2 CC x I2C0-scFc VH CDR3
ATYTTGWSYFDY

SEQ ID NO: 421 - protein, 11 aa, Artificial Sequence
  Synthetic Polypeptide
  MISC_FEATURE: MU 2-C2 CC x I2C0-scFc VL CDR1
SGDKLGDKYAS

SEQ ID NO: 422 - protein, 7 aa, Artificial Sequence
  Synthetic Polypeptide
  MISC_FEATURE: MU 2-C2 CC x I2C0-scFc VL CDR2
QDAKRPS

SEQ ID NO: 423 - protein, 9 aa, Artificial Sequence
  Synthetic Polypeptide
  MISC_FEATURE: MU 2-C2 CC x I2C0-scFc VL CDR3
QAFHQSTWV

SEQ ID NO: 424 - protein, 121 aa, Artificial Sequence
  Synthetic Polypeptide
  MISC_FEATURE: MU 2-C2 CC x I2C0-scFc VH
QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSS

SEQ ID NO: 425 - protein, 106 aa, Artificial Sequence
  Synthetic Polypeptide
  MISC_FEATURE: MU 2-C2 CC x I2C0-scFc VL
SYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVL

SEQ ID NO: 426 - protein, 242 aa, Artificial Sequence
  Synthetic Polypeptide
  MISC_FEATURE: MU 2-C2 CC x I2C0-scFc scFv
QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVL

SEQ ID NO: 427 - protein, 497 aa, Artificial Sequence
  Synthetic Polypeptide
  MISC_FEATURE: MU 2-C2 CC x I2C0-scFc Bispecific molecule
QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 428 - protein, 985 aa, Artificial Sequence
  Synthetic Polypeptide
  MISC_FEATURE: MU 2-C2 CC x I2C0-scFc Bispecific HLE molecule
QVQLVESGGGVVQPGRSLRLSCAASGFTFSNHGMHWVRQAPGKCLEWVAGIWSEGSNKYYADAVKGRFTISRDNSKNTLYLQMNSLRAEDTAVYYCARATYTTGWSYFDYWGQGTLVTVSSGGGGSGGGGSGGGGSSYELTQPPSVSVSPGQTASITCSGDKLGDKYASWYQQKSGQSPVLVIYQDAKRPSGIPERFSGSNSGNTATLTISGTQAMDEADYYCQAFHQSTWVFGCGTQLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 429 - protein, 5 aa, Artificial Sequence
  Synthetic Polypeptide
  MISC_FEATURE: MU 2-A3 CC x I2C0-scFc VH CDR1
SFGMH

SEQ ID NO: 430 - protein, 17 aa, Artificial Sequence
  Synthetic Polypeptide
  MISC_FEATURE: MU 2-A3 CC x I2C0-scFc VH CDR2
VIWFDASNKYYAESVKG

SEQ ID NO: 431 - protein, 9 aa, Artificial Sequence
  Synthetic Polypeptide
  MISC_FEATURE: MU 2-A3 CC x I2C0-scFc VH CDR3
GGYTYGFDY

SEQ ID NO: 432 - protein, 11 aa, Artificial Sequence
  Synthetic Polypeptide
  MISC_FEATURE: MU 2-A3 CC x I2C0-scFc VL CDR1
RASQAINRYLA

SEQ ID NO: 433 - protein, 7 aa, Artificial Sequence
  Synthetic Polypeptide
  MISC_FEATURE: MU 2-A3 CC x I2C0-scFc VL CDR2
GASSRAT

SEQ ID NO: 434 - protein, 9 aa, Artificial Sequence
  Synthetic Polypeptide
  MISC_FEATURE: MU 2-A3 CC x I2C0-scFc VL CDR3
QHYGSSIFT

SEQ ID NO: 435 - protein, 118 aa, Artificial Sequence; identical to SEQ ID NO: 105
  Synthetic Polypeptide
  MISC_FEATURE: MU 2-A3 CC x I2C0-scFc VH

SEQ ID NO: 436 - protein, 107 aa, Artificial Sequence
  Synthetic Polypeptide
  MISC_FEATURE: MU 2-A3 CC x I2C0-scFc
EIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIK

SEQ ID NO: 437 - protein, 240 aa, Artificial Sequence
  Synthetic Polypeptide
  MISC_FEATURE: MU 2-A3 CC x I2C0-scFc scFv VL
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIK

SEQ ID NO: 438 - protein, 495 aa, Artificial Sequence
  Synthetic Polypeptide
  MISC_FEATURE: MU 2-A3 CC x I2C0-scFc Bispecific molecule
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 439 - protein, 983 aa, Artificial Sequence
  Synthetic Polypeptide
  MISC_FEATURE: MU 2-A3 CC x I2C0-scFc Bispecific HLE molecule
QVQLVESGGGVVQPGRSLRLSCAASGFTFSSFGMHWVRQAPGKCLEWVAVIWFDASNKYYAESVKGRFTISRDNSKNTLYLQMNSLRAEDTAVYYCARGGYTYGFDYWGQGTLVTVSSGGGGSGGGGSGGGGSEIVLTQSPGTLSVSPGERATLSCRASQAINRYLAWYQQKPGQAPRLLIYGASSRATGIPDRFSGSGSGTDFTLTISRLEPEDFAVYYCQHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 440 - protein, 5 aa, Artificial Sequence
  Synthetic Polypeptide
  MISC_FEATURE: MU 1-H2 CC x I2C0-scFc VH CDR1
SYGMH

SEQ ID NO: 441 - protein, 17 aa, Artificial Sequence
  Synthetic Polypeptide
  MISC_FEATURE: MU 1-H2 CC x I2C0-scFc VH CDR2
VIWYDASNKYYATSVKG

SEQ ID NO: 442 - protein, 9 aa, Artificial Sequence
  Synthetic Polypeptide
  MISC_FEATURE: MU 1-H2 CC x I2C0-scFc VH CDR3
GGYTYGFDY

SEQ ID NO: 443 - protein, 11 aa, Artificial Sequence
  Synthetic Polypeptide
  MISC_FEATURE: MU 1-H2 CC x I2C0-scFc VL CDR1
RASQSINRYLA

SEQ ID NO: 444 - protein, 7 aa, Artificial Sequence
  Synthetic Polypeptide
  MISC_FEATURE: MU 1-H2 CC x I2C0-scFc VL CDR2
TASNRAT

SEQ ID NO: 445 - protein, 9 aa, Artificial Sequence
  Synthetic Polypeptide
  MISC_FEATURE: MU 1-H2 CC x I2C0-scFc VL CDR3
HHYGSSIFT

SEQ ID NO: 446 - protein, 118 aa, Artificial Sequence
  Synthetic Polypeptide
  MISC_FEATURE: MU 1-H2 CC x I2C0-scFc VH
QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSS

SEQ ID NO: 447 - protein, 107 aa, Artificial Sequence; identical to SEQ ID NO: 205
  Synthetic Polypeptide
  MISC_FEATURE: MU 1-H2 CC x I2C0-scFc VL

SEQ ID NO: 448 - protein, 240 aa, Artificial Sequence
  Synthetic Polypeptide
  MISC_FEATURE: MU 1-H2 CC x I2C0-scFc scFv
QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 449 - protein, 495 aa, Artificial Sequence
  Synthetic Polypeptide
  MISC_FEATURE: MU 1-H2 CC x I2C0-scFc Bispecific molecule
QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 450 - protein, 983 aa, Artificial Sequence
  Synthetic Polypeptide
  MISC_FEATURE: MU 1-H2 CC x I2C0-scFc Bispecific HLE molecule
QVQLVESGGGLVKPGGSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 451 - protein, 5 aa, Artificial Sequence
  Synthetic Polypeptide
  MISC_FEATURE: MU 1-E9 CC x I2C0-scFc VH CDR1
SYGMH

SEQ ID NO: 452 - protein, 17 aa, Artificial Sequence
  Synthetic Polypeptide
  MISC_FEATURE: MU 1-E9 CC x I2C0-scFc VH CDR2
VIWFHGSNKYYAESVKG

SEQ ID NO: 453 - protein, 9 aa, Artificial Sequence
  Synthetic Polypeptide
  MISC_FEATURE: MU 1-E9 CC x I2C0-scFc VH CDR3
GAYTYGFDY

SEQ ID NO: 454 - protein, 11 aa, Artificial Sequence
  Synthetic Polypeptide
  MISC_FEATURE: MU 1-E9 CC x I2C0-scFc VL CDR1
RASQSINRYLA

SEQ ID NO: 455 - protein, 7 aa, Artificial Sequence
  Synthetic Polypeptide
  MISC_FEATURE: MU 1-E9 CC x I2C0-scFc VL CDR2
TASNRAT

SEQ ID NO: 456 - protein, 9 aa, Artificial Sequence
  Synthetic Polypeptide
  MISC_FEATURE: MU 1-E9 CC x I2C0-scFc VL CDR3
HHYGSSIFT

SEQ ID NO: 457 - protein, 118 aa, Artificial Sequence
  Synthetic Polypeptide
  MISC_FEATURE: MU 1-E9 CC x I2C0-scFc VH
QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSS

SEQ ID NO: 458 - protein, 107 aa, Artificial Sequence; identical to SEQ ID NO: 205
  Synthetic Polypeptide
  MISC_FEATURE: MU 1-E9 CC x I2C0-scFc VL

SEQ ID NO: 459 - protein, 240 aa, Artificial Sequence
  Synthetic Polypeptide
  MISC_FEATURE: MU 1-E9 CC x I2C0-scFc scFv
QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 460 - protein, 495 aa, Artificial Sequence
  Synthetic Polypeptide
  MISC_FEATURE: MU 1-E9 CC x I2C0-scFc Bispecific molecule
QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 461 - protein, 983 aa, Artificial Sequence
  Synthetic Polypeptide
  MISC_FEATURE: MU 1-E9 CC x I2C0-scFc Bispecific HLE molecule
QVQLVESGGGVVKPGRSLRLSCAASGFTFSSYGMHWVRQAPGKCLEWVAVIWFHGSNKYYAESVKGRFTISRDNSKNTLYLQMNNLRAEDTAVYYCARGAYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 462 - protein, 5 aa, Artificial Sequence
  Synthetic Polypeptide
  MISC_FEATURE: MU 1-B10 CC x I2C0-scFc VH CDR1
NFGMH

SEQ ID NO: 463 - protein, 17 aa, Artificial Sequence
  Synthetic Polypeptide
  MISC_FEATURE: MU 1-B10 CC x I2C0-scFc VH CDR2
VIWFDASKTYYAEAVKG

SEQ ID NO: 464 - protein, 12 aa, Artificial Sequence
  Synthetic Polypeptide
  MISC_FEATURE: MU 1-B10 CC x I2C0-scFc VH CDR3
ATYSTGWSYFDY

SEQ ID NO: 465 - protein, 11 aa, Artificial Sequence
  Synthetic Polypeptide
  MISC_FEATURE: MU 1-B10 CC x I2C0-scFc VL CDR1
SGDKLGDKYTS

SEQ ID NO: 466 - protein, 7 aa, Artificial Sequence
  Synthetic Polypeptide
  MISC_FEATURE: MU 1-B10 CC x I2C0-scFc VL CDR2
HDAKRPS

SEQ ID NO: 467 - protein, 10 aa, Artificial Sequence
  Synthetic Polypeptide
  MISC_FEATURE: MU 1-B10 CC x I2C0-scFc VL CDR3
QAWSASTAWV

SEQ ID NO: 468 - protein, 121 aa, Artificial Sequence; identical to SEQ ID NO: 248
  Synthetic Polypeptide
  MISC_FEATURE: MU 1-B10 CC x I2C0-scFc VH

SEQ ID NO: 469 - protein, 107 aa, Artificial Sequence; identical to SEQ ID NO: 337
  Synthetic Polypeptide
  MISC_FEATURE: MU 1-B10 CC x I2C0-scFc VL

SEQ ID NO: 470 - protein, 243 aa, Artificial Sequence
  Synthetic Polypeptide
  MISC_FEATURE: MU 1-B10 CC x I2C0-scFc scFv
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVL

SEQ ID NO: 471 - protein, 498 aa, Artificial Sequence
  Synthetic Polypeptide
  MISC_FEATURE: MU 1-B10 CC x I2C0-scFc Bispecific molecule
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 472 - protein, 986 aa, Artificial Sequence
  Synthetic Polypeptide
  MISC_FEATURE: MU 1-B10 CC x I2C0-scFc Bispecific HLE molecule
QVQLVESGGGVVQPGRSLRLSCAASGFTFSNFGMHWVRQAPGKCLEWVAVIWFDASKTYYAEAVKGRFTISRDTSMNTLYLQMNSLRAEDTAVYYCARATYSTGWSYFDYWGQGTLVTVSSGGGGSGGGGSGGGGSSYELTQPPSVSVSPGQTASITCSGDKLGDKYTSWYQQKPGQSPVLVIYHDAKRPSGIPERFSGSNSGNTATLTISGTQAMDEADYYCQAWSASTAWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 473 - protein, 5 aa, Artificial Sequence
  Synthetic Polypeptide
  MISC_FEATURE: MU 1-B6 CC x I2C0-scFc VH CDR1
GYYWS

SEQ ID NO: 474 - protein, 16 aa, Artificial Sequence
  Synthetic Polypeptide
  MISC_FEATURE: MU 1-B6 CC x I2C0-scFc VH CDR2
DIDYSGSTKYNPSLKS

SEQ ID NO: 475 - protein, 12 aa, Artificial Sequence
  Synthetic Polypeptide
  MISC_FEATURE: MU 1-B6 CC x I2C0-scFc VH CDR3
KKYSTVWSYFDY

SEQ ID NO: 476 - protein, 11 aa, Artificial Sequence
  Synthetic Polypeptide
  MISC_FEATURE: MU 1-B6 CC x I2C0-scFc VL CDR1
SGDKLGDKYAN

SEQ ID NO: 477 - protein, 7 aa, Artificial Sequence
  Synthetic Polypeptide
  MISC_FEATURE: MU 1-B6 CC x I2C0-scFc VL CDR2
HDNKRPS

SEQ ID NO: 478 - protein, 9 aa, Artificial Sequence
  Synthetic Polypeptide
  MISC_FEATURE: MU 1-B6 CC x I2C0-scFc VL CDR3
QAYGISSAV

SEQ ID NO: 479 - protein, 120 aa, Artificial Sequence; identical to SEQ ID NO: 292
  Synthetic Polypeptide
  MISC_FEATURE: MU 1-B6 CC x I2C0-scFc VH

SEQ ID NO: 480 - protein, 106 aa, Artificial Sequence
  Synthetic Polypeptide
  MISC_FEATURE: MU 1-B6 CC x I2C0-scFc VL
SYELTQPASASVSPGQTASITCSGDKLGDKYANWYQQKPGQSPILVIYHDNKRPSGIPERFSGSNSGNTATLTISGTQAMDEADYYCQAYGISSAVFGCGTKLTVL

SEQ ID NO: 481 - protein, 241 aa, Artificial Sequence
  Synthetic Polypeptide
  MISC_FEATURE: MU 1-B6 CC x I2C0-scFc scFv
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPASASVSPGQTASITCSGDKLGDKYANWYQQKPGQSPILVIYHDNKRPSGIPERFSGSNSGNTATLTISGTQAMDEADYYCQAYGISSAVFGCGTKLTVL

SEQ ID NO: 482 - protein, 496 aa, Artificial Sequence
  Synthetic Polypeptide
  MISC_FEATURE: MU 1-B6 CC x I2C0-scFc Bispecific molecule
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPASASVSPGQTASITCSGDKLGDKYANWYQQKPGQSPILVIYHDNKRPSGIPERFSGSNSGNTATLTISGTQAMDEADYYCQAYGISSAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 483 - protein, 984 aa, Artificial Sequence
  Synthetic Polypeptide
  MISC_FEATURE: MU 1-B6 CC x I2C0-scFc Bispecific HLE molecule
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPASASVSPGQTASITCSGDKLGDKYANWYQQKPGQSPILVIYHDNKRPSGIPERFSGSNSGNTATLTISGTQAMDEADYYCQAYGISSAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 484 - protein, 5 aa, Artificial Sequence
  Synthetic Polypeptide
  MISC_FEATURE: MU 1-A6 CC x I2C0-scFc VH CDR1
GYYWS

SEQ ID NO: 485 - protein, 16 aa, Artificial Sequence
  Synthetic Polypeptide
  MISC_FEATURE: MU 1-A6 CC x I2C0-scFc VH CDR2
DIDQSGSTKYNPSLKS

SEQ ID NO: 486 - protein, 12 aa, Artificial Sequence
  Synthetic Polypeptide
  MISC_FEATURE: MU 1-A6 CC x I2C0-scFc VH CDR3
KKYSTVWSYFDY

SEQ ID NO: 487 - protein, 11 aa, Artificial Sequence
  Synthetic Polypeptide
  MISC_FEATURE: MU 1-A6 CC x I2C0-scFc VL CDR1
SGDKLGDKYAS

SEQ ID NO: 488 - protein, 7 aa, Artificial Sequence
  Synthetic Polypeptide
  MISC_FEATURE: MU 1-A6 CC x I2C0-scFc VL CDR2
QDRKRPS

SEQ ID NO: 489 - protein, 9 aa, Artificial Sequence
  Synthetic Polypeptide
  MISC_FEATURE: MU 1-A6 CC x I2C0-scFc VL CDR3
QAWGSSAAV

SEQ ID NO: 490 - protein, 120 aa, Artificial Sequence; identical to SEQ ID NO: 171
  Synthetic Polypeptide
  MISC_FEATURE: MU 1-A6 CC x I2C0-scFc VH

SEQ ID NO: 491 - protein, 106 aa, Artificial Sequence
  Synthetic Polypeptide
  MISC_FEATURE: MU 1-A6 CC x I2C0-scFc VL
SYELTQPSSVSVPPGQTASITCSGDKLGDKYASWYQQKPGQSPVLVIYQDRKRPSGVPERFSGSNSGNTATLTISGTQAMDEADYYCQAWGSSAAVFGCGTKLTVL

SEQ ID NO: 492 - protein, 241 aa, Artificial Sequence
  Synthetic Polypeptide
  MISC_FEATURE: MU 1-A6 CC x I2C0-scFc scFv
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSAAVFGCGTKLTVL

SEQ ID NO: 493 - protein, 496 aa, Artificial Sequence
  Synthetic Polypeptide
  MISC_FEATURE: MU 1-A6 CC x I2C0-scFc Bispecific molecule
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 494 - protein, 984 aa, Artificial Sequence
  Synthetic Polypeptide
  MISC_FEATURE: MU 1-A6 CC x I2C0-scFc Bispecific HLE molecule
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 495 - protein, 5 aa, Artificial Sequence
  Synthetic Polypeptide
  MISC_FEATURE: MU 0-F9 CC x I2C0-scFc VH CDR1
SFGMH

SEQ ID NO: 496 - protein, 17 aa, Artificial Sequence
  Synthetic Polypeptide
  MISC_FEATURE: MU 0-F9 CC x I2C0-scFc VH CDR2
VIWYTGSNKYYASSVKG

SEQ ID NO: 497 - protein, 9 aa, Artificial Sequence
  Synthetic Polypeptide
  MISC_FEATURE: MU 0-F9 CC x I2C0-scFc VH CDR3
GGYTYGFDY

SEQ ID NO: 498 - protein, 11 aa, Artificial Sequence
  Synthetic Polypeptide
  MISC_FEATURE: MU 0-F9 CC x I2C0-scFc VL CDR1
RASQSINRYLA

SEQ ID NO: 499 - protein, 7 aa, Artificial Sequence
  Synthetic Polypeptide
  MISC_FEATURE: MU 0-F9 CC x I2C0-scFc VL CDR2
TASNRAT

SEQ ID NO: 500 - protein, 9 aa, Artificial Sequence
  Synthetic Polypeptide
  MISC_FEATURE: MU 0-F9 CC x I2C0-scFc VL CDR3
HHYGSSIFT

SEQ ID NO: 501 - protein, 118 aa, Artificial Sequence
  Synthetic Polypeptide
  MISC_FEATURE: MU 0-F9 CC x I2C0-scFc VH
QVQLVESGGGLVKPGGSLRLSCAASGFTFSSFGMHWVRQAPGKCLEWVAVIWYTGSNKYYASSVKGRFTISRDNSKNTLYLQMNNLRAEDTAVYYCARGGYTYGFDYWGQGTLVTVSS

SEQ ID NO: 502 - protein, 107 aa, Artificial Sequence; identical to SEQ ID NO: 205
  Synthetic Polypeptide
  MISC_FEATURE: MU 0-F9 CC x I2C0-scFc VL

SEQ ID NO: 503 - protein, 240 aa, Artificial Sequence
  Synthetic Polypeptide
  MISC_FEATURE: MU 0-F9 CC x I2C0-scFc scFv
QVQLVESGGGLVKPGGSLRLSCAASGFTFSSFGMHWVRQAPGKCLEWVAVIWYTGSNKYYASSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 504 - protein, 495 aa, Artificial Sequence
  Synthetic Polypeptide
  MISC_FEATURE: MU 0-F9 CC x I2C0-scFc Bispecific molecule
QVQLVESGGGLVKPGGSLRLSCAASGFTFSSFGMHWVRQAPGKCLEWVAVIWYTGSNKYYASSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 505 - protein, 983 aa, Artificial Sequence
  Synthetic Polypeptide
  MISC_FEATURE: MU 0-F9 CC x I2C0-scFc Bispecific HLE molecule
QVQLVESGGGLVKPGGSLRLSCAASGFTFSSFGMHWVRQAPGKCLEWVAVIWYTGSNKYYASSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 506 - protein, 5 aa, Artificial Sequence
  Synthetic Polypeptide
  MISC_FEATURE: MU 0-F6 CC x I2C0-scFc VH CDR1
SYGMH

SEQ ID NO: 507 - protein, 17 aa, Artificial Sequence
  Synthetic Polypeptide
  MISC_FEATURE: MU 0-F6 CC x I2C0-scFc VH CDR2
VIWFDASNKYYAESVKG

SEQ ID NO: 508 - protein, 9 aa, Artificial Sequence
  Synthetic Polypeptide
  MISC_FEATURE: MU 0-F6 CC x I2C0-scFc VH CDR3
GGYTYGFDY

SEQ ID NO: 509 - protein, 11 aa, Artificial Sequence
  Synthetic Polypeptide
  MISC_FEATURE: MU 0-F6 CC x I2C0-scFc VL CDR1
RASQSINRYLA

SEQ ID NO: 510 - protein, 7 aa, Artificial Sequence
  Synthetic Polypeptide
  MISC_FEATURE: MU 0-F6 CC x I2C0-scFc VL CDR2
TASNRAT

SEQ ID NO: 511 - protein, 9 aa, Artificial Sequence
  Synthetic Polypeptide
  MISC_FEATURE: MU 0-F6 CC x I2C0-scFc VL CDR3
HHYGSSIFT

SEQ ID NO: 512 - protein, 118 aa, Artificial Sequence
  Synthetic Polypeptide
  MISC_FEATURE: MU 0-F6 CC x I2C0-scFc VH
QVQLVESGGGLVKPGRSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSS

SEQ ID NO: 513 - protein, 107 aa, Artificial Sequence; identical to SEQ ID NO: 205
  Synthetic Polypeptide
  MISC_FEATURE: MU 0-F6 CC x I2C0-scFc VL

SEQ ID NO: 514 - protein, 240 aa, Artificial Sequence
  Synthetic Polypeptide
  MISC_FEATURE: MU 0-F6 CC x I2C0-scFc scFv
QVQLVESGGGLVKPGRSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 515 - protein, 495 aa, Artificial Sequence
  Synthetic Polypeptide
  MISC_FEATURE: MU 0-F6 CC x I2C0-scFc Bispecific molecule
QVQLVESGGGLVKPGRSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 516 - protein, 983 aa, Artificial Sequence
  Synthetic Polypeptide
  MISC_FEATURE: MU 0-F6 CC x I2C0-scFc Bispecific HLE molecule
QVQLVESGGGLVKPGRSLRLSCAASGFTFSSYGMHWVRQAPGKCLEWVAVIWFDASNKYYAESVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 517 - protein, 5 aa, Artificial Sequence
  Synthetic Polypeptide
  MISC_FEATURE: MU 0-E5 CC x I2C0-scFc VH CDR1
SYGMH

SEQ ID NO: 518 - protein, 17 aa, Artificial Sequence
  Synthetic Polypeptide
  MISC_FEATURE: MU 0-E5 CC x I2C0-scFc VH CDR2
VIWYDASNKYYATSVKG

SEQ ID NO: 519 - protein, 9 aa, Artificial Sequence
  Synthetic Polypeptide
  MISC_FEATURE: MU 0-E5 CC x I2C0-scFc VH CDR3
GGYTYGFDY

SEQ ID NO: 520 - protein, 11 aa, Artificial Sequence
  Synthetic Polypeptide
  MISC_FEATURE: MU 0-E5 CC x I2C0-scFc VL CDR1
RASQSINRYLA

SEQ ID NO: 521 - protein, 7 aa, Artificial Sequence
  Synthetic Polypeptide
  MISC_FEATURE: MU 0-E5 CC x I2C0-scFc VL CDR2
TASNRAT

SEQ ID NO: 522 - protein, 9 aa, Artificial Sequence
  Synthetic Polypeptide
  MISC_FEATURE: MU 0-E5 CC x I2C0-scFc VL CDR3
HHYGSSIFT

SEQ ID NO: 523 - protein, 118 aa, Artificial Sequence
  Synthetic Polypeptide
  MISC_FEATURE: MU 0-E5 CC x I2C0-scFc VH
QVQLVESGGGVVKPGRSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSS

SEQ ID NO: 524 - protein, 107 aa, Artificial Sequence; identical to SEQ ID NO: 205
  Synthetic Polypeptide
  MISC_FEATURE: MU 0-E5 CC x I2C0-scFc VL

SEQ ID NO: 525 - protein, 240 aa, Artificial Sequence
  Synthetic Polypeptide
  MISC_FEATURE: MU 0-E5 CC x I2C0-scFc scFv
QVQLVESGGGVVKPGRSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIK

SEQ ID NO: 526 - protein, 495 aa, Artificial Sequence
  Synthetic Polypeptide
  MISC_FEATURE: MU 0-E5 CC x I2C0-scFc Bispecific molecule
QVQLVESGGGVVKPGRSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 527 - protein, 983 aa, Artificial Sequence
  Synthetic Polypeptide
  MISC_FEATURE: MU 0-E5 CC x I2C0-scFc Bispecific HLE molecule
QVQLVESGGGVVKPGRSLRLSCAASGFTFSSYGMHWVRQAPGKCLEWVAVIWYDASNKYYATSVKGRFTISRDNSKNTLYLQMNNLRAEDTAVYYCARGGYTYGFDYWGQGTLVTVSSGGGGSGGGGSGGGGSEIVLTQSPGTLSLSPGERATLSCRASQSINRYLAWYQQKPGQAPRLLIYTASNRATGIPDRFSGSGSGTDFTLTISRLEPEDFAVYYCHHYGSSIFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 528 - protein, 126 aa, Artificial Sequence
  Synthetic Polypeptide
  MISC_FEATURE: MUC17 epitope E2
EVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCF

SEQ ID NO: 529 - protein, 107 aa, Artificial Sequence
  Synthetic Polypeptide
  MISC_FEATURE: MUC17 epitope E2 (shortened)
SAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICS

SEQ ID NO: 530 - protein, 113 aa, Artificial Sequence
  Synthetic Polypeptide
  MISC_FEATURE: MUC17 epitope 5A (part of E2)
RTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLG

SEQ ID NO: 531 - protein, 146 aa, Artificial Sequence
  Synthetic Polypeptide
  MISC_FEATURE: MUC17 epitope 5B (part of E2)
SVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKS

SEQ ID NO: 532 - protein, 220 aa, Artificial Sequence
  Synthetic Polypeptide
  MISC_FEATURE: MUC17 epitope E2 trunk2
EVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSL

SEQ ID NO: 533 - protein, 207 aa, Artificial Sequence
  Synthetic Polypeptide
  MISC_FEATURE: MUC17 epitope E2 trunk3
ISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSL

SEQ ID NO: 534 - protein, 99 aa, Artificial Sequence
  Synthetic Polypeptide
  MISC_FEATURE: MUC17 epitope E2 trunk4
DMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSL

SEQ ID NO: 535 - protein, 50 aa, Artificial Sequence
  Synthetic Polypeptide
  MISC_FEATURE: MUC17 epitope E2 trunk5
SPCEPGFSVSKNCNLGKCQMSLSGPQCLCVTTETHWYSGETCNQGTQKSL

SEQ ID NO: 536 - protein, 109 aa, Homo Sapiens
ELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 537 - protein, 109 aa, Homo Sapiens
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 538 - protein, 5 aa, Homo Sapiens
KYAMN

SEQ ID NO: 539 - protein, 19 aa, Homo Sapiens
RIRSKYNNYATYYADSVKG

SEQ ID NO: 540 - protein, 19 aa, Homo Sapiens
RIRSKYNNYATYYADSVKS

SEQ ID NO: 541 - protein, 19 aa, Homo Sapiens
RIRSKYNNYATYYADSVKD

SEQ ID NO: 542 - protein, 7 aa, Homo Sapiens
GTKFLAP

SEQ ID NO: 543 - protein, 14 aa, Homo Sapiens
HGNFGNSYISYWAY

SEQ ID NO: 544 - protein, 125 aa, Homo Sapiens
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 545 - protein, 125 aa, Homo Sapiens
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 546 - protein, 9 aa, Homo Sapiens
ALWYSNRWV

SEQ ID NO: 547 - protein, 5 aa, Homo Sapiens
SYAMN

SEQ ID NO: 548 - protein, 5 aa, Homo Sapiens
VYAMN

SEQ ID NO: 549 - protein, 19 aa, Homo Sapiens
RIRSKYNNYATYYADSVKK

SEQ ID NO: 550 - protein, 109 aa, Homo Sapiens
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 551 - protein, 109 aa, Homo Sapiens
ELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 552 - protein, 109 aa, Homo Sapiens
ELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 553 - protein, 5 aa, Homo Sapiens
IYAMN

SEQ ID NO: 554 - protein, 14 aa, Homo Sapiens
HGNFGNSYVSFFAY

SEQ ID NO: 555 - protein, 125 aa, Homo Sapiens
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 556 - protein, 125 aa, Homo Sapiens
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 557 - protein, 14 aa, Homo Sapiens
GSSTGAVTSGYYPN

SEQ ID NO: 558 - protein, 14 aa, Homo Sapiens
HGNFGNSYLSFWAY

SEQ ID NO: 559 - protein, 125 aa, Homo Sapiens
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 560 - protein, 125 aa, Homo Sapiens
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 561 - protein, 5 aa, Homo Sapiens
RYAMN

SEQ ID NO: 562 - protein, 14 aa, Homo Sapiens
HGNFGNSYLSYFAY

SEQ ID NO: 563 - protein, 125 aa, Homo Sapiens
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 564 - protein, 125 aa, Homo Sapiens
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 565 - protein, 14 aa, Homo Sapiens
HGNFGNSYLSWWAY

SEQ ID NO: 566 - protein, 125 aa, Homo Sapiens
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 567 - protein, 125 aa, Homo Sapiens
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 568 - protein, 14 aa, Homo Sapiens
HGNFGNSYTSYYAY

SEQ ID NO: 569 - protein, 125 aa, Homo Sapiens
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 570 - protein, 125 aa, Homo Sapiens
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 571 - protein, 14 aa, Homo Sapiens
RSSTGAVTSGYYPN

SEQ ID NO: 572 - protein, 7 aa, Homo Sapiens
ATDMRPS

SEQ ID NO: 573 - protein, 5 aa, Homo Sapiens
GYAMN

SEQ ID NO: 574 - protein, 19 aa, Homo Sapiens
RIRSKYNNYATYYADSVKE

SEQ ID NO: 575 - protein, 14 aa, Homo Sapiens
HRNFGNSYLSWFAY

SEQ ID NO: 576 - protein, 125 aa, Homo Sapiens
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 577 - protein, 125 aa, Homo Sapiens
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 578 - protein, 14 aa, Homo Sapiens
HGNFGNSYISWWAY

SEQ ID NO: 579 - protein, 125 aa, Homo Sapiens
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 580 - protein, 125 aa, Homo Sapiens
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 581 - protein, 14 aa, Homo Sapiens
GSSTGAVTSGNYPN

SEQ ID NO: 582 - protein, 9 aa, Homo Sapiens
VLWYSNRWV

SEQ ID NO: 583 - protein, 14 aa, Homo Sapiens
HGNFGNSYVSWWAY

SEQ ID NO: 584 - protein, 125 aa, Homo Sapiens
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 585 - protein, 125 aa, Homo Sapiens
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 586 - protein, 249 aa, Homo Sapiens
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 587 - protein, 249 aa, Homo Sapiens
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 588 - protein, 249 aa, Homo Sapiens
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 589 - protein, 249 aa, Homo Sapiens
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 590 - protein, 249 aa, Homo Sapiens
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 591 - protein, 249 aa, Homo Sapiens
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 592 - protein, 249 aa, Homo Sapiens
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 593 - protein, 249 aa, Homo Sapiens
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 594 - protein, 249 aa, Homo Sapiens
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 595 - protein, 249 aa, Homo Sapiens
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 596 - protein, 249 aa, Homo Sapiens
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 597 - protein, 249 aa, Homo Sapiens
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 598 - protein, 249 aa, Homo Sapiens
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 599 - protein, 249 aa, Homo Sapiens
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 600 - protein, 249 aa, Homo Sapiens
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 601 - protein, 249 aa, Homo Sapiens
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 602 - protein, 249 aa, Homo Sapiens
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 603 - protein, 249 aa, Homo Sapiens
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 604 - protein, 249 aa, Homo Sapiens
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 605 - protein, 249 aa, Homo Sapiens
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

The invention claimed is:

1. A bispecific antibody construct comprising:
    a first domain comprising an antibody which binds to MUC17, wherein the antibody comprises a CDR-H1 as set forth in the amino acid sequence of SEQ ID NO: 176, a CDR-H2 as set forth in the amino acid sequence of SEQ ID NO: 177, a CDR-H3 as set forth in the amino acid sequence of SEQ ID NO: 178, a CDR-L1 as set forth in in the amino acid sequence of SEQ ID NO: 179, a CDR-L2 as set forth in the amino acid sequence of SEQ ID NO: 180, and a CDR-L3 as set forth in the amino acid sequence of SEQ ID NO: 181, and
    a second domain comprising an antibody which binds to an extracellular epitope of the human CD3ε chain.

2. The bispecific antibody construct of claim 1 further comprising a third domain which comprises two polypeptide monomers, each monomer comprising a hinge, a CH2 domain and a CH3 domain, wherein the two polypeptide monomers are fused to each other via a peptide linker.

3. The bispecific antibody construct of claim 2, wherein the third domain comprises in an amino to carboxyl order: hinge-CH2-CH3-linker-hinge-CH2-CH3.

4. The bispecific antibody construct of claim 2, wherein each of the polypeptide monomers of the third domain comprises an amino acid sequence that is at least 90% identical to an amino acid sequence selected from the group consisting of: SEQ ID NO: 17-24.

5. The bispecific antibody construct of claim 2, wherein the first and second domains are fused to the third domain via a peptide linker.

6. The bispecific antibody construct of claim 1, wherein the antibody construct is a bispecific single chain antibody construct.

7. The bispecific antibody construct of claim 1, wherein
    (i) the antibody which binds to MUC 17 comprises two antibody variable domains and the antibody which binds to the human CD3ε chain comprises two antibody variable domains; or
    (ii) the antibody which binds to MUC 17 comprises two antibody variable domains and the antibody which binds to the human CD3ε chain comprises a single domain antibody.

8. The bispecific antibody construct of claim 1, wherein the antibody construct comprises in an amino to carboxyl order:
    (a) the first domain;
    (b) a peptide linker comprising the amino acid sequence of SEQ ID NO: 1, 2, or 3; and
    (c) the second domain.

9. The bispecific antibody construct of claim 8, wherein the antibody construct further comprises in an amino to carboxyl order after the second domain:
- (d) a peptide linker comprising the amino acid sequence of SEQ ID NO: 1, 2, 3, 9, 10, 11 or 12;
- (e) a first polypeptide monomer of a third domain;
- (f) a peptide linker comprising the amino acid sequence of SEQ ID NO: 5, 6, 7, or 8; and
- (g) a second polypeptide monomer of the third domain.

10. The bispecific antibody construct of claim 1, wherein the first binding domain comprises a VL region comprising the amino acid sequence of SEQ ID NO: 183 and a VH region comprising the amino acid sequence of SEQ ID NO: 182.

11. The bispecific antibody construct of claim 1, wherein the first domain comprises the amino acid sequence of SEQ ID NO: 184.

12. The bispecific antibody construct of claim 1, wherein the antibody construct comprises in an amino to carboxyl order:
- (a) the first domain comprising the antibody comprising the amino acid sequence of SEQ ID NO: 184;
- (b) a peptide linker comprising the amino acid sequence of SEQ ID NO: 1, 2, or 3; and
- (c) the second domain comprising the antibody comprising an amino acid sequence selected from the group consisting of: SEQ ID NOs: 586-605 and 15.

13. The bispecific antibody construct of claim 12, wherein the antibody construct further comprises in an amino to carboxyl order:
- (d) a peptide linker which links the first and second domains to a third domain, the peptide linker comprising an amino acid sequence selected from the group consisting of: SEQ ID NOs: 1, 2, 3, 9, 10, 11 and 12;
- (e) a first polypeptide monomer of the third domain comprising an amino sequence selected from the group consisting of: SEQ ID NOs: 17-24;
- (f) a peptide linker comprising an amino acid sequence selected from the group consisting of: SEQ ID NOs: 5, 6, 7 and 8; and
- (g) a second polypeptide monomer of the third domain comprising an amino sequence selected from the group consisting of: SEQ ID NOs: 17-24.

14. The bispecific antibody construct of claim 1 comprising
- (a) the amino acid sequence of SEQ ID NO: 185 or 186; or
- (b) an amino acid sequence comprising at least 90% identity to the amino acid sequence of SEQ ID NO: 185 or 186.

15. A pharmaceutical composition comprising the bispecific antibody construct of claim 1, and a carrier, stabilizer, excipient, diluent, solubilizer, surfactant, emulsifier, preservative, and/or adjuvant.

16. A kit comprising the bispecific antibody construct of claim 1 and a means for reconstituting or diluting the antibody construct.

17. The bispecific antibody construct of claim 1, wherein the second domain further binds to an extracellular epitope of the *Macaca* CD3ε chain.

18. The bispecific antibody construct of claim 1, wherein the first binding domain comprises an antibody comprising a VL region comprising an amino acid sequence having at least 90% identity to the sequence set forth in SEQ ID NO. 183 and a VH region comprising an amino acid sequence having at least 90% identity to the sequence set forth in SEQ ID NO. 182.

19. The bispecific antibody construct of claim 1, wherein the first domain comprises an antibody comprising an amino acid sequence having at least 90% identity to a sequence comprising the amino acid sequence of SEQ ID NO: 184.

* * * * *